US011123418B2

(12) United States Patent
Moraes et al.

(10) Patent No.: US 11,123,418 B2
(45) Date of Patent: Sep. 21, 2021

(54) SLAM POLYNUCLEOTIDES AND POLYPEPTIDES AND USES THEREOF

(71) Applicant: Engineered Antigens Inc., Calgary (CA)

(72) Inventors: Trevor F. Moraes, Toronto (CA); Christine Chieh-Lin Lai, Toronto (CA); Yogesh Hooda, Toronto (CA); Andrew Judd, Mississauga (CA); Anthony B. Schryvers, Calgary (CA); Scott D. Gray-Owen, Oakville (CA)

(73) Assignee: Engineered Antigens Inc., Calgary (CA)

( * ) Notice: Subject to any disclaimer, the term of this patent is extended or adjusted under 35 U.S.C. 154(b) by 77 days.

(21) Appl. No.: 16/077,112

(22) PCT Filed: Feb. 10, 2017

(86) PCT No.: PCT/CA2017/050160
§ 371 (c)(1),
(2) Date: Aug. 10, 2018

(87) PCT Pub. No.: WO2017/136947
PCT Pub. Date: Aug. 17, 2017

(65) Prior Publication Data

US 2019/0111122 A1 Apr. 18, 2019

Related U.S. Application Data

(60) Provisional application No. 62/293,491, filed on Feb. 10, 2016.

(51) Int. Cl.

| | |
|---|---|
| ***A61K 39/02*** | (2006.01) |
| ***A61K 39/095*** | (2006.01) |
| ***C07K 14/195*** | (2006.01) |
| ***C07K 14/22*** | (2006.01) |
| *A61K 39/00* | (2006.01) |

(52) U.S. Cl.
CPC ............ *A61K 39/095* (2013.01); *A61K 39/02* (2013.01); *C07K 14/195* (2013.01); *C07K 14/22* (2013.01); *A61K 2039/522* (2013.01); *A61K 2039/523* (2013.01); *Y02A 50/30* (2018.01)

(58) Field of Classification Search
None
See application file for complete search history.

(56) References Cited

FOREIGN PATENT DOCUMENTS

| | | | |
|---|---|---|---|
| CA | 2931685 A1 | | 6/2015 |
| WO | 2006/027584 A2 | | 3/2006 |
| WO | 2006027584 A2 | * | 3/2006 |
| WO | 2009/114485 A2 | | 9/2009 |

OTHER PUBLICATIONS

Zhong et al. American Soc. Microbio. 2013. 33(6): 1223-1232.*
Yan et al. Fly (2018) 12(3-4): 191-198.*
Lauber et al. ( mBio, Oct. 25, 2016 (Oct. 25, 2016), V. 7(5): e01232-16.*
Mikayama et al. (Nov. 1993. Proc.Natl.Acad.Sci. USA, vol. 90 : 10056-10060).*
Calmettes, C. et al., "Structural aspects of bacterial outer membrane protein assembly", Advances in Experimental Medicine and Biology, 2015, vol. 883, p. 255-70.
Danve, B. et al. "Transferrin-binding proteins isolated from Neisseria meningitidis elicit protective and bacterial antibodies in laboratory animals", Vaccine, 1993, vol. 11(12), p. 1214-1220.
Feavers, I.M. et al., "Meningococcal protein antigens and vaccines", Vaccine, 2009, vol. 27S, p. B42-B50.
Hooda, Y. et al., "Slam is an outer membrane protein that is required for the surface display of lapidated virulence actors in Neisseria", Nature Microbiology, ePub. Feb. 29, 2016, vol. 1, p. 16009.
Lauber, F. et al., "Identification of a new lipoprotein export signal in gram-negative bacteria", mBio, Oct. 25, 2016, vol. 7(5), p. e01232-16.
Pajon, R. et al., "A nature outer membrane vesicle vaccine confers protection against meningococcal colonization in human CEACAM1 transgenic mice", Vaccine, Mar. 10, 2015, vol. 33(11), p. 1317-1323.
Salverda, M.L.M., et al., "Surface display of a borrelial lipoprotein on meningococcal outer membrane vesicles", Vaccine, ePub: Jan. 19, 2016, vol. 34, p. 1025-1033.
Database UniParc [Online] uniprot; Apr. 6, 2006, Database accession No. UPI00025C57E9.

* cited by examiner

*Primary Examiner* — Jennifer E Graser
(74) *Attorney, Agent, or Firm* — Bereskin & Parr LLP/S.E.N.C.R.L., s.r.l.

(57) ABSTRACT

The present disclosure relates to methods for exporting target proteins (e.g., surface lipoproteins) from the cytosol to the extracellular surface of bacterial cells using surface lipoprotein assembly modulator (SLAM) polypeptides. The use of SLAM polypeptides in a method of preparing vaccines useful in the prevention of bacterial infectious diseases is also taught.

10 Claims, 15 Drawing Sheets

Specification includes a Sequence Listing.

A

B

SLAM POLYNUCLEOTIDES AND POLYPEPTIDES AND USES THEREOF

CROSS-REFERENCE TO RELATED APPLICATION

This application is a national phase entry application of Patent Cooperation Treaty Application No. PCT/CA2017/050160 filed Feb. 10, 2017 (which designates the U.S.), which claims the benefit of U.S. Provisional Patent Application No. 62/293,491 filed Feb. 10, 2016. The entire contents of U.S. Provisional Patent Application 62/293,491 and PCT/CA2017/050160 are hereby incorporated by reference in its their entirety.

INCORPORATION OF SEQUENCE LISTING

A computer readable form of the Sequence Listing "21806-P47204US02_SequenceListing.txt" (3,66,912 bytes), submitted via EFS-WEB and created on Aug. 2, 2018 and amended on Jan. 7, 2019, is herein incorporated by reference.

FIELD OF THE DISCLOSURE

The present disclosure relates to a class of polypeptides known as surface lipoprotein assembly modulator polypeptides, or SLAM polypeptides, and polynucleotides encoding SLAM polypeptides, and substrates thereof, surface lipoproteins (SLPs). The SLAM polypeptides are obtainable from Gram-negative bacterial species. The SLAM polypeptides and polynucleotides are useful in the prevention and treatment of infectious diseases caused by pathogenic bacterial species, including, for example, bacterial species belonging to the genus *Neisseria.*

BACKGROUND OF THE DISCLOSURE

The following paragraphs are intended to introduce the reader to the more detailed description that follows and not to define or limited the claimed subject matter of the present disclosure.

Pathogenic bacterial species, including bacterial species belonging to the genus *Neisseria* are causative agents of large epidemic diseases. Thus, for example meningitis is caused by *Neisseria meningitidis*, and gonorrhea, is caused by *Neisseria gonorrhoeae*. The World Health Organization (WHO) reported over 88,000 suspected cases of meningitis in 2009 in 14 countries within the sub-Saharan Africa of the so called "meningitis belt", of which more than 5,300 resulted in death (WHO Fact Sheet No 141, November 2012). Sporadic meningitis outbreaks occur elsewhere, including in North America, as well. Gonorrhea has been estimated to affect over 100 million people worldwide with 820,000 new cases being reported in the US alone, on an annual basis. While antibiotics, such as ampicillin, tetracycline and quinolones, offer treatment options against *Neisseria* infections, resistance to these antibiotics is an increasingly significant concern. Vaccines offering protection against *Neisseria* infections have been developed, however there is an ongoing need for additional vaccines, as depending on the serogroup, efficacy of the vaccines varies. Thus, for example, the efficacy of a vaccine known as 4CMenB, a four-component vaccine against *Neisseria meningitidis* serogroup B, remains to be established and paediatric use in Canada is only recommended for individuals at the highest risk of invasive meningococcal disease (Robinson J L, Paediatric Child Health, 2014 19(2): 91-94). There are still no vaccines available for *N. gonorrhoeae.*

Therefore there is a need in the art to develop further treatment and prevention options against infections caused by pathogenic *Neisseria* species and other pathogenic bacterial species.

SUMMARY OF THE DISCLOSURE

In one aspect, the present disclosure relates to a class of polypeptides known as surface lipoprotein assembly modulator (SLAM) polypeptides.

In another aspect, the present disclosure relates to the production of SLAM polypeptides in host cells, including pathogenic or non-pathogenic bacterial cells.

In another aspect, the present disclosure relates to the transport of certain target proteins within a cell from the cytosol to the extracellular surface area of the cell.

Accordingly, in one aspect, the present disclosure provides, in at least one embodiment, a method of effecting transport of a target protein from the cytosol to the extracellular surface of a host cell comprising the target protein, the method comprising:

(a) providing a chimeric polynucleotide comprising as operably linked components:
 (i) a polynucleotide capable of controlling expression in the host cell; and
 (ii) a polynucleotide encoding a SLAM polypeptide; and
(b) introducing the chimeric polynucleotide in the host cell and growing the host cell to produce the SLAM polypeptide, thereby effecting transport of the target protein from the cytosol to the extracellular surface of the host cell.

In some embodiments, the host cell is a Gram-negative bacterial cell.

In some embodiments, the host cell is a pathogenic bacterial cell.

In some embodiments, the host cell is a cell selected from bacterial cells belonging to the genus *Neisseria, Klebsiella, Moraxella, Mannheimia, Actinobacillus, Haemophilus, Pasteurella, Acinetobacter, Escherichia* or *Vibrio.*

In some embodiments, the host cell is selected from bacterial cells belonging to the species *Neisseria meningitidis, Neisseria gonorrhoeae, Neisseria lactamica, Neisseria cincera, Klebsiella denitrificans, Moraxella catarrhalis, Mannheimia haemolytica, Actinobacillus pleuropneomoniae, Haemophilus somni, Haemophilus influenzae, Pasteurella multocida, Acinetobacter baumannii, Escherichia coli* or *Vibrio cholera.*

In some embodiments, the SLAM polypeptide is not naturally present in the host cell.

In some embodiments, the target protein is naturally present in the host cell.

In some embodiments, the target protein is not naturally present in the host cell.

In some embodiments, the target protein is non-covalently associated to the SLAM polypeptide.

In some embodiments, the target protein is covalently linked to the SLAM polypeptide.

In some embodiments, the target protein is an immunogen capable of eliciting an immune response in a host organism.

In some embodiments, the target protein is an immunogenic polypeptide, or an immunogenic portion thereof, that is naturally displayed on the exterior surface of a pathogenic microorganism.

In some embodiments, the target protein is a surface lipoprotein (SLP).

In some embodiments, the surface lipoprotein (SLP) comprises or consists of a sequence selected from one of the even-numbered SEQ ID NOs: SEQ ID NO: 696 to SEQ ID NO: 1082; SEQ ID NO: 1094; SEQ ID NO: 1100; even-numbered SEQ ID NOs: 1116 to SEQ ID NO: 1168; and SEQ ID NO; 1178 set forth herein.

In some embodiments, the surface lipoprotein is selected from a transferrin binding protein B (TbpB), a hemoglobin-haptoglobin binding protein A (HpuA), a Factor H binding protein (fHbp), and a lactoferrin binding protein (LbpB).

In some embodiments, the transferrin binding protein B (TbpB) comprises or consists of a sequence selected from SEQ ID NO: 806, SEQ ID NO: 828, SEQ ID NO: 868, SEQ ID NO: 1094, and one of the even-numbered SEQ ID NOs: SEQ ID NO: 1148 to SEQ ID NO: 1168 set forth herein; the hemoglobin-haptoglobin binding protein A (HpuA) comprises or consists of a sequence selected from one of SEQ ID NO: 850, SEQ ID NO: 924, SEQ ID NO: 932, or SEQ ID NO: 1110 set forth herein, the Factor H binding protein (fHbp) comprises or consists of a sequence selected from one of the even-numbered SEQ ID NOs: SEQ ID NO: 1116 to SEQ ID NO:1136 set forth herein, and the lactoferrin binding protein (LbpB) comprises or consists of a sequence selected from SEQ ID NO: 870 or one of the even-numbered SEQ ID NOs: SEQ ID NO: 1138 to SEQ ID NO: 1146 set forth herein.

In some embodiments, the polynucleotide encoding the SLAM polypeptide comprises or consists of a sequence selected from one of the odd-numbered SEQ ID NOs: SEQ ID NO: 1 to SEQ ID NO: 693 set forth herein.

In some embodiments, the target protein comprises or consists of a sequence selected from one of the even-numbered SEQ ID NOs: SEQ ID NO: 696 to SEQ ID NO: 1082, SEQ ID NO: 1094; SEQ ID NO: 1100; even-numbered SEQ ID NOs: 1116 to SEQ ID NO: 1168; and SEQ ID NO; 1178.

In another aspect, the present disclosure provides, in at least one embodiment, a method of effecting transport of a target protein from the cytosol to the extracellular surface of a host cell comprising:

(a) selecting a host cell comprising a target protein naturally present in the cell;
(b) providing a chimeric polynucleotide comprising as operably linked components:
  (i) a polynucleotide capable of controlling expression in the host cell; and
  (ii) a polynucleotide encoding a SLAM polypeptide; and
(c) introducing the chimeric nucleic acid sequence in the host cell and growing the host cell to produce the SLAM polypeptide and effect transport of the target protein from the cytosol to the extracellular surface.

In another aspect, the present disclosure provides, in at least one embodiment, a method of effecting transport of a target protein from the cytosol to the extracellular surface of a host cell comprising:

(a) providing a chimeric polynucleotide comprising as operably linked components:
  (i) a polynucleotide capable of controlling expression in the host cell;
  (ii) a polynucleotide encoding a SLAM polypeptide; and
  (iii) a polynucleotide encoding a target protein; and
(b) introducing the chimeric nucleic acid sequence in the host cell and growing the host cell to produce the SLAM polypeptide and effect transport of the target protein from the cytosol to the extracellular surface.

In another aspect, the present disclosure provides a method of effecting transport of a target protein from the cytosol to the extracellular surface of a host cell comprising:

(a) providing a first chimeric polynucleotide comprising as operably linked components:
  (i) a polynucleotide capable of controlling expression in the host cell; and
  (ii) a polynucleotide encoding a SLAM polypeptide; and
(b) providing a second chimeric polynucleotide comprising as operably linked components:
  (i) a polynucleotide capable of controlling expression in the host cell; and
  (ii) a polynucleotide encoding a target protein; and
  (c) introducing the first and second chimeric polynucleotide in the host cell and growing the host cell to produce the SLAM polypeptide and the target protein and effect transport of the target protein from the cytosol to the extracellular surface.

In another aspect, the present disclosure relates to novel polynucleotides encoding SLAM polypeptides. Accordingly, the present disclosure provides, in at least one embodiment, a polynucleotide comprising or consisting of SEQ ID NO: 1183.

In some embodiments, the polynucleotide encoding a SLAM polypeptide wherein the SLAM polynucleotide has been modified to facilitate expression of a SLAM polypeptide in a host cell.

In some embodiments, the polynucleotide encoding the SLAM polypeptide has been codon-optimized.

In some embodiments, the codon-optimized polynucleotide comprises or consists of a sequence set forth in SEQ ID NO: 1113.

In some embodiments, the polynucleotide encoding the polynucleotide SLAM polypeptide additionally comprises a signal sequence.

In another aspect, the present disclosure relates to novel polypeptides. Accordingly the present disclosure provides, in at least one embodiment, a polypeptide comprising or consisting of SEQ ID NO: 1184.

In another aspect, the present disclosure provides, in at least one embodiment, a method of preparing a vaccine comprising:

(a) selecting a host cell capable of producing an immunogen;
(b) providing a chimeric polynucleotide comprising as operably linked components:
  (i) a polynucleotide capable of controlling expression in the host cell; and
  (ii) a polynucleotide encoding a SLAM polypeptide; and
(c) introducing the chimeric nucleic acid sequence in the host cell and growing the host cell to produce the SLAM polypeptide and the immunogen;
(d) attenuating the host cell to prepare an attenuated host cell; and
(e) preparing a vaccine formulation using the attenuated host cell.

In another aspect, the present disclosure provides, in at least one embodiment, a method of preparing a vaccine comprising:

(a) providing a first chimeric polynucleotide comprising as operably linked components:
  (i) a polynucleotide capable of controlling expression in the host cell;

(ii) a polynucleotide encoding a SLAM polypeptide; and (b) providing a second chimeric polynucleotide comprising as operably linked components:

(i) a polynucleotide capable of controlling expression in the host cell; and (ii) a polynucleotide encoding a target protein; and (c) introducing the first and second chimeric polynucleotide in the host cell and growing the host cell to produce the SLAM polypeptide and the target protein; and (d) preparing a vaccine formulation using the cells of (c).

In another aspect, the present disclosure provides, in at least one embodiment, a method of preparing a vaccine comprising:

(a) providing a chimeric polynucleotide comprising as operably linked components:

(i) a polynucleotide capable of controlling expression in the host cell;

(ii) a polynucleotide encoding a SLAM polypeptide; and (iii) a polynucleotide encoding a target protein; and (b) introducing the chimeric polynucleotide in the host cell and growing the host cell to produce the SLAM polypeptide and the target protein; and (c) preparing a vaccine formulation using the cells of (b).

In another aspect, the present disclosure provides, in at least one embodiment, a method of preparing a vaccine against a pathogenic bacterial infection comprising:

(a) providing a pathogenic bacterial strain comprising a nucleic acid sequence encoding a SLAM polypeptide;

(b) impairing SLAM production in the pathogenic strain to obtain a SLAM impaired pathogenic bacterial strain; and (c) using the SLAM impaired pathogenic strain to formulate a vaccine.

In another aspect, the present disclosure provides, in at least one embodiment, a vaccine preparation made according to any of the methods of the present disclosure.

In another aspect, the present disclosure provides, in at least one embodiment, a use of a vaccine preparation made according to any of the methods of the present disclosure to immunize a host organism.

In some embodiments, the vaccine preparation provides protection against an infectious disease mediated by a bacterial organism.

In another aspect, the present disclosure provides, in at least one embodiment, a screening method for identifying a candidate compound for use in the treatment of patients infected by a pathogenic bacterial species, the method comprising:

(a) providing a test compound;

(b) comparing in a functional assay the effect of the test compound with a control on the function of a SLAM polypeptide in the pathogenic bacterial species; and (c) identifying a test compound exhibiting an effect on the native function of a SLAM polypeptide.

In some embodiments, the pathogenic bacterial species belongs to the genus *Neisseria*.

In another aspect, the present disclosure provides, in at least one embodiment, a method for identifying a target protein capable of being transported by a SLAM polypeptide from the cytosol to the extracellular surface of a cell, the method comprising:

(a) providing a genomic nucleotide sequence comprising (i) a first nucleotide sequence encoding a SLAM polypeptide; and (ii) a second nucleotide sequence sufficiently long to encode a polypeptide and naturally attached to the first nucleotide sequence;

(b) evaluating the second nucleotide sequence to identify a polypeptide encoding sequence within the second nucleotide sequence; and (c) using the polypeptide encoding sequence to express the polypeptide in a host cell comprising a SLAM polypeptide to determine whether the protein is transported from the cytosol to the extracellular surface of the host cell, to thereby identify whether the protein is a target protein.

In some embodiments, the first nucleotide sequences comprises a sequence selected from any one of the odd-numbered SEQ ID NOs: SEQ ID NO 1 to SEQ ID NO: 695 set forth herein.

Other features and advantages of the present disclosure will become apparent from the following detailed description. It should be understood, however, that the detailed description, while indicating preferred embodiments of the disclosure, are given by way of illustration only, since various changes and modifications within the spirit and scope of the disclosure will become apparent to those of skill in the art from the detailed description.

BRIEF DESCRIPTION OF THE DRAWINGS

The disclosure is in the hereinafter provided paragraphs described in relation to its Figures. The Figures provided herein are provided for illustration purposes and are not intended to limit the present disclosure.

FIG. 2A: Size-exclusion chromatography (SEC) using a S200 column. FIG. 2B The peak containing SLAM1 was analyzed using coomassie stained SD S-PAGE and further concentrated and used for crystallization trials using commercially available screens. FIG. 2C Initial crystal hits are shown for SLAM1.

FIG. 4A: Construct used for purification contains a N-terminal pelB sequence (for protein localization) and 6×His tag (for NiNTA purification). FIG. 4B: The different fractions collected after NiNTA purification shows that eluted fractions contain SLAM2. FIG. 4C: Western blots of fractions confirm the presence of a His tag with an expected mol. weight of SLAM2. Boiled and unboiled fractions were tested. FIG. 4D: Following NiNTA purification, samples were further purified using size-exclusion chromatography (SEC) using a S200 column. The figure shows the profile obtained from the SEC run. The peak containing SLAM2 was further concentrated and used for crystallization trials using commercially available screens. FIG. 4E: Initial crystal hits are shown for SLAM2.

FIG. 7A shows a solid phase binding assay consisting of *N. meningitidis* cells fixed with paraformaldehyde (PFA) or lysed with SDS, spotted onto nitrocellulose and probed with α-TbpB antibodies. ΔSLAM/tn5 refers to the original strain of SLAM deficient cells obtained through transposon insertion. ΔSLAM describes the knockout of SLAM in *N. meningitidis* obtained by replacing the SLAM open reading frame (ORF) with a kanamycin resistance cassette. FIG. 7B shows a Proteinase K digestion assay showing the degradation of TbpB, LbpB and fHbp only when Nm cells are SLAM deficient (ΔSLAM). *N. meningitidis* cells expressing individual SLPs alone and with SLAM were incubated with proteinase K and Western blots were used to detect levels of all three SLPs levels with and without protease digestion (+/−). Flow cytometry was used to confirm that SLAM cells could not display TbpB (FIG. 7C) or fHbp (FIG. 7D) on the cell surface. Antibodies against TbpB and fHbp were used to bind surface exposed SLPs followed by incubation with a secondary α-Rabbit antibody linked to phycoerythrin to provide fluorescence. The mean fluorescence intensity (MFI) of each sample was measured using the FL2 detector of a BD FACS Calibur. The signal obtained from wildtype cells was set to 100% for comparison with signals from knockout cells. Error bars represent the standard error of the mean (SEM) from three experiments. Shown in FIG. 7E are the results of mice infections with various strains. Mice were infected via intraperitoneal injection with $1\times10^6$ CFU of wildtype *N. meningitidis* strain B16B6, B16B6 with a knockout of TbpB (ΔtbpB), or B16B6 with a knockout of nmb0313 Δslam and monitored for survival and disease symptoms every 12 h starting 48 hr pre-infection to 48 h post-infection and additionally monitored at 3 hr post-infection. Statistical differences in survival were assessed by a Mantel-Cox log rank test (GraphPad Prism 5) (*$p<0.05$, n.s. not significant).

FIG. 9A shows the domain architecture of *N. meningitidis* SLAM1, possessing two domains: a periplasmic N-terminal domain (Ntd) containing tetratricopeptide repeats and a membrane bound 14-stranded barrel domain referred to as DUF560. FIG. 9B shows the distribution of SLAM proteins in Proteobacteria. A family tree of Proteobacteria was made using 16S-RNA sequences from 55 species representing the major bacterial families within Proteobactria. The families containing at least one species with a SLAM homolog are highlighted by black dots. SLAM homologs were found within all clades of Proteobacteria.

FIG. 10A shows the SLAM and TbpB gene cluster in *M. catarrhalis* and *H. influenzae*. From the bioinformatics analysis performed, SLAM was found adjacent to known transferrin binding surface lipoprotein TbpB in both human pathogens. FIG. 10B shows the schematic diagram of the *E. coli* translocation assay used in this study. Briefly, SLAM and TbpB genes were expressed in *E. coli* C43 (DE3) cells. The cells were labeled with biotinylated human transferrin and streptavidin linked to the R-phycoerthyrin (PE). Surface display of TbpB was quantified using Flow Cytometry. FIG. 10C shows the Flow Cytometry profiles of *M. catarrhalis* TbpB (McTbpB) and *H. influenzae* TbpB (HiTbpB) obtained with SLAM (shown in black) or without SLAM (shown in gray). A higher signal was observed in the presence of SLAM, indicating the reliance on SLAM for effective surface expression of SLPs. FIG. 10D shows the mean fluorescence blots for TbpB homologs from *M. catarrhalis* and *H. influenzae* using mean fluorescence intensity. Statistical significant was determined using one-way ANOVA where *** represents $p\leq0.001$.

FIG. 11A shows a SLAM gene cluster in *P. multocida* strain Pm70. PM1515 (shown in black) was identified as a SLAM homolog in our bioinformatics search. PM1514 (shown in gray) was annotated as a hypothetical protein. PM1514 contains a signal peptidase II cleavage site ending with a putative lipobox (ITAC) motif. FIG. 11B shows *P. multocida* gene constructs made for a translocation assay to investigate if PM1514 is a SLAM-dependent SLP. Briefly, PM1514 was cloned with a C-terminal Flag-tag (PM1514-Flag), PM1515 was cloned with an N-terminal His-tag and pelB signal sequence, and PM1515-PM1514-Flag was cloned with both PM1515 and PM1514 regions. FIG. 11C shows the Flow Cytometry profiles of *P. multocida* constructs where all three constructs detailed in FIG. 11B were expressed in *E. coli* C43 (DE3) cells and labeled with α-Flag antibody and a mouse secondary antibody linked to R-phycoerthyrin (PE). Flow Cytometry profiles of PM1514-Flag (light gray), PM1515 and PM1514-Flag (black) and PM1515-PM1514-Flag (dark gray) are shown. FIG. 11D shows the Mean fluorescence intensity blots quantified using mean fluorescence intensity (MFI) of the *P. multocida* constructs. Statistical significance was determined using one-way ANOVA where *** denotes $p\leq0.001$.

FIG. 12A shows the *N. meningitidis* TbpB and HpuA constructs used in this study, including wildtype TbpB, wildtype HpuA, TbpB N-lobe, TbpB C-lobe, and the TbpB N-lobe fused to HpuA (Nlobe_HpuA). FIG. 12B shows the translocation efficiency of the N- and C-lobe of TbpB as quantified by Flow Cytometry of *E. coli* C43 (DE3) cells expressing full length or individual lobes of *N. meningitidis* TbpB and *N. meningitidis* SLAM1 after labeling with α-TbpB and rabbit-FITC antibodies. FIGS. 12C, 12D and FIG. 12E show the translocation efficiency of Nlobe_HpuA with α-TbpB, α-HpuA, and biotinylated human transferrin, respectively. The ability of SLAM1 and SLAM2 to potentiate the translocation of Nlobe-HpuA to the surface of *E. coli* was tested using Flow Cytometry. α-TbpB and biotinylated human transferrin were used to detect the TbpB N-lobe while HpuA was detected using α-HpuA. Mean fluorescence intensity blots are shown and highlight that swapping the TbpB C-lobe with HpuA swaps the specificity of the construct from SLAM1 to SLAM2. Statistical significance was determined using one-way ANOVA where * denotes $p \leq 0.001$, ** denotes $p \leq 0.0001$ and n.s. denotes non significant.

FIG. 13A shows the general structure of the protein domains found on SLAM-dependent SLPs. This family of proteins contains a flexible handle domain and an eight-stranded barrel domain. The barrel domain is conserved amongst all putative SLAM-dependent SLPs. FIG. 13B shows a schematic of the barrel domain from *N. meningitidis* TbpB where the strands are numbered according to the structure of TbpB from *N. meningitidis* strain B16B6 (PDB ID: 4QQ1). The strands mutated by polyalanine mutations are denoted by B22, B23, B30 and B31. FIG. 13C and FIG. 13D show the translocation efficiency of *E. coli* C43 (DE3) cells expressing one of TbpB wildtype alone, SLAM1 and TbpB wildtype, or SLAM1 and TbpB mutants containing polyalanine mutations in four different beta-barrel strands. Cells were labeled with α-TbpB and biotinylated human transferrin and mean fluorescence intensity blots determined that mutations in the last two strands of the TbpB C-lobe barrel prevent surface display of TbpB. Western blot analysis with α-TbpB and α-His were done to confirm expression of TbpB C-lobe mutants and SLAM1, respectively. FIG. 13E shows a multiple sequence alignment of the last two strands of the C-terminal beta-barrel of SLAM-dependent SLPs with conserved residues highlighted in gray. FIG. 13F shows an overlay of conserved residues on the last two beta-barrel strands in the C-lobe structure of TbpB. The two strands are shown facing each other with the residues inside the barrel domain facing each other while residues outside the barrel are away from one another. The conserved residues cluster together at the center of the barrel domain. Statistical significance was determined using a one-way ANOVA where * denotes $p \leq 0.001$, ** denotes $p \leq 0.0001$ and n.s. denotes non significant.

FIG. 14A shows a SLAM gene cluster in *A. baumannii* strain LAC4. AbSLAM (shown in gray) was identified as a SLAM homolog in a bioinformatics search. AbSLP (shown in black) was annotated as a hypothetical protein. FIG. 14B shows *A. baumannii* gene constructs made for a translocation assay to investigate if AbSLP is a Slam-dependent SLP. Briefly, AbSLP was cloned with a C-terminal Flag-tag (AbSLP-Flag), AbSLAM was cloned with an N-terminal His-tag and pelB signal sequence. FIG. 14B (right) shows the Flow Cytometry profiles of *A. baumannii* constructs where both constructs detailed were expressed in *E. coli* C43 (DE3) cells and labeled with ⍰-Flag antibody and a mouse secondary antibody linked to R-phycoerthyrin (PE). FIG. 14C shows the AbSLP crystals that were formed (left) and a cartoon diagram of the identified crystal structure of AbSLP. FIG. 14D shows the PK shaving assay in *A. baumannii.*

DETAILED DESCRIPTION OF THE DISCLOSURE

Figure 1:
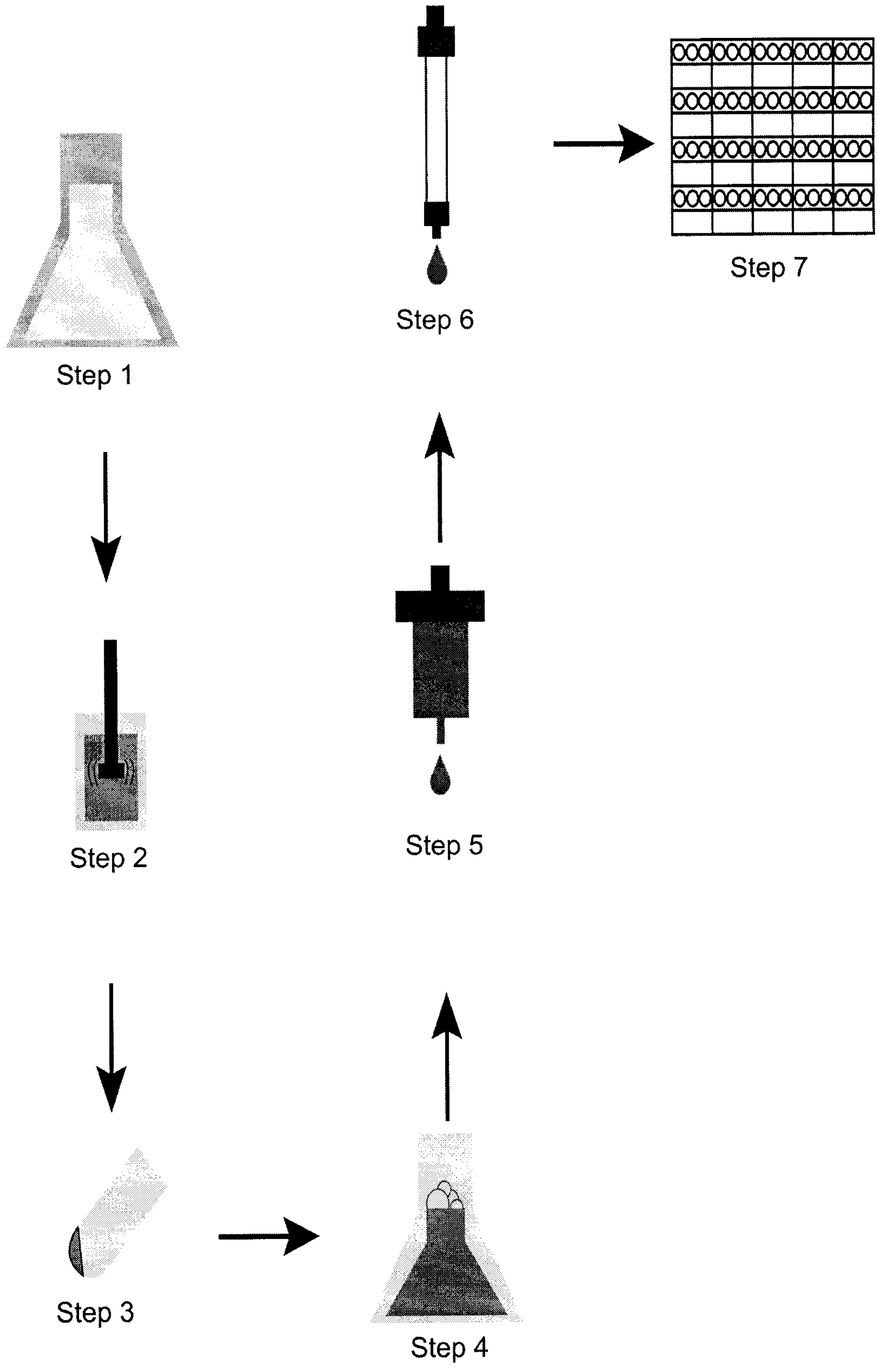
FIG. 1 shows a diagram outlining a methodology for purification of SLAMs. Step 1: Cells transformed with a plasmid containing 5H3 are grown at 37° C. until the desired optical density is reached. At this point expression is induced with the addition of IPTG. Step 2: After overnight growth, cells are harvested by centrifugation. Cells are then lysed by sonication in the presence of lysozyme and DNAse. Step 3: The membrane fraction of the lysate is isolated through ultracentrifugation. Step 4: The membrane pellet is resuspended and membrane proteins are extracted from the membrane overnight in 50 mM potassium phosphate (pH 7.5, 3% Elugent and PMSF). Step 5: The extraction solution is loaded onto a nickel-NTA column. The column is washed with increasing amounts of imiziadole before 5H3 is eluted from the column with all buffers containing 0.6ˆC8E4. Step 6: Concentrated fractions containing 5H3 are loaded onto a gel filtration column for further purification and detergent exchange. Step 7: Fractions containing 5H3 are pooled and concentrated and the protein is used in subsequent crystal screens.

Various compositions and methods will be described below to provide an example of an embodiment of each claimed subject matter. No embodiment described below limits any claimed subject matter and any claimed subject matter may cover methods, processes, compositions or systems that differ from those described below. The claimed subject matter is not limited to compositions or methods having all of the features of any one composition, method, system or process described below or to features common to multiple or all of the compositions, systems or methods described below. It is possible that a composition, system, method or process described below is not an embodiment of any claimed subject matter. Any subject matter disclosed in a composition, system, method or process described below that is not claimed in this document may be the subject matter of another protective instrument, for example, a continuing patent application, and the applicants, inventors or owners do not intend to abandon, disclaim or dedicate to the public any such subject matter by its disclosure in this document. All publications, patents and patent applications are herein incorporated by reference in their entirety to the same extent as if each individual publication.

Terms and Definitions

Unless defined otherwise, all technical and scientific terms used herein shall have the same meaning as commonly understood by one of ordinary skill in the art to which the disclosure pertains. The following terms shall be understood to have the following meanings.

The interchangeably herein used terms "surface lipoprotein assembly modulator", "SLAM", "SLAM protein", and "SLAM polypeptide" refer to any and all SLAM proteins, including those set forth in any one of the even-numbered SEQ ID NOs: SEQ ID NO: 2 to SEQ ID NO: 694 and SEQ ID NO: 1184, and those comprising a sequence of amino acid residues which (i) are substantially identical to the amino acid sequences constituting any SLAM protein set forth herein; (ii) are encoded by a nucleic acid sequence capable of hybridizing under at least moderately stringent conditions to any nucleic acid sequence encoding any SLAM protein set forth herein or capable of hybridizing under at least moderately stringent conditions to any nucleic acid sequence encoding any SLAM protein set forth herein, but for the use of synonymous codons. The terms further include any SLAM precursor polypeptides.

The term "surface lipoprotein", refers to any and all surface lipoproteins, including those set forth in one of the even-numbered SEQ ID NOs: SEQ ID NO: 696 to SEQ ID NO: 1082, SEQ ID NO: 1094, SEQ ID NO: 1100 and even-numbered SEQ ID NOs: 1116 to SEQ ID NO: 1168, and SEQ ID NO; 1178 set forth herein, and those comprising a sequence of amino acid residues which (i) are substantially identical to the amino acid sequences constituting any surface lipoprotein set forth herein; (ii) are encoded by a nucleic acid sequence capable of hybridizing under at least moderately stringent conditions to any nucleic acid sequence encoding any surface lipoprotein set forth herein or capable of hybridizing under at least moderately stringent conditions to any nucleic acid sequence encoding any surface lipoprotein set forth herein, but for the use of synonymous codons. The term surface lipoprotein, further, can refer to polypeptides comprising the surface lipoprotein box sequence motifs set forth in SEQ ID NO: 1170 and SEQ ID NO: 1174 and those comprising a sequence of amino acid residues which (i) are substantially identical to the amino acid sequences constituting any surface lipoprotein box sequence motif set forth herein; or (ii) are encoded by a nucleic acid sequence capable of hybridizing under at least moderately stringent conditions to any nucleic acid sequence encoding any surface lipoprotein box sequence motif set forth herein or capable of hybridizing under at least moderately stringent conditions to any nucleic acid sequence encoding any surface lipoprotein box sequence motif set forth herein, but for the use of synonymous codons.

The interchangeably herein used terms “transferrin binding protein B”, “TbpB protein”, “TbpB polypeptide” and “TbpB” refer to any and all TbpB proteins, including those set forth in sequences selected from SEQ ID NO: 806, SEQ ID NO: 828, SEQ ID NO: 868, SEQ ID NO: 1094, and one of the even-numbered SEQ ID NOs: SEQ ID NO: 1148 to SEQ ID NO: 1168 set forth herein and those comprising a sequence of amino acid residues which (i) are substantially identical to the amino acid sequences constituting any TbpB protein set forth herein; (ii) are encoded by a nucleic acid sequence capable of hybridizing under at least moderately stringent conditions to any nucleic acid sequence encoding any TbpB protein set forth herein or capable of hybridizing under at least moderately stringent conditions to any nucleic acid sequence encoding any TbpB protein set forth herein, but for the use of synonymous codons.

The interchangeably herein used terms “lactoferrin binding protein”, “LbpB protein”, “LbpB polypeptide” and “LbpB” refer to any and all LbpB proteins, including those set forth in sequences selected from SEQ ID NO: 870 or one of the even-numbered SEQ ID NOs: SEQ ID NO: 1138 to SEQ ID NO: 1146 set forth herein 6, and those comprising a sequence of amino acid residues which (i) are substantially identical to the amino acid sequences constituting any LbpB protein set forth herein; (ii) are encoded by a nucleic acid sequence capable of hybridizing under at least moderately stringent conditions to any nucleic acid sequence encoding any LbpB protein set forth herein or capable of hybridizing under at least moderately stringent conditions to any nucleic acid sequence encoding any LbpB protein set forth herein, but for the use of synonymous codons.

The interchangeably herein used terms “Factor H binding protein”, “fHbp protein”, fHbp polypeptide” and “fHbp” refer to any and all fHbp proteins, including those sequences selected from one of the even-numbered SEQ ID NOs: SEQ ID NO: 1116 to SEQ ID NO: 1136 set forth herein, and those comprising a sequence of amino acid residues which (i) are substantially identical to the amino acid sequences constituting any fHbp protein set forth herein; (ii) are encoded by a nucleic acid sequence capable of hybridizing under at least moderately stringent conditions to any nucleic acid sequence encoding any fHbp protein set forth herein or capable of hybridizing under at least moderately stringent conditions to any nucleic acid sequence encoding any fHbp protein set forth herein, but for the use of synonymous codons.

The interchangeably herein used terms “hemoglobin-haptoglobin binding protein A”, “HpuA protein”, “HpuA polypeptide” and “HpuA” refer to any and all HpuA proteins, including those set forth in SEQ ID NO: 850, SEQ ID NO: 924, SEQ ID NO: 932, or SEQ ID NO: 1110 and those comprising a sequence of amino acid residues which (i) are substantially identical to the amino acid sequences constituting any HpuA protein set forth herein; (ii) are encoded by a nucleic acid sequence capable of hybridizing under at least moderately stringent conditions to any nucleic acid sequence encoding any HpuA protein set forth herein or capable of hybridizing under at least moderately stringent conditions to any nucleic acid sequence encoding any HpuA protein set forth herein, but for the use of synonymous codons.

The herein interchangeably used terms “polynucleotide encoding a surface lipoprotein assembly modulator”; “polynucleotide encoding a SLAM polypeptide”; and polynucleotide encoding a SLAM protein refer to any and all polynucleotides encoding a SLAM polypeptide, including any SLAM polypeptide and any nucleic acid sequences that encode SLAM precursors, including the polynucleotides set forth in SEQ ID NO: 1 and SEQ ID NO: 3. As used herein “SLAM precursor” refers to a SLAM molecule additionally comprising an N-terminal signal sequence which facilitates export of the polypeptide chain across the cytoplasmic membrane of *E. coli* and other Gram-negative bacterial species. Polynucleotides encoding a SLAM polypeptide further include any and all polynucleotides which (i) encode polypeptides that are substantially identical to the SLAM polypeptide sequences set forth herein; or (ii) hybridize to any SLAM polynucleotides set forth herein under at least moderately stringent hybridization conditions or which would hybridize thereto under at least moderately stringent conditions but for the use of synonymous codons.

The term “polynucleotide encoding a surface lipoprotein” refers to any and all polynucleotides encoding a surface lipoprotein, including any surface lipoprotein, including the polynucleotide set forth in odd-numbered SEQ ID NOs including SEQ ID NO: 695 to SEQ ID NO: 1081, and SEQ ID NO: 1177 set forth herein. Polynucleotides encoding a surface lipoprotein further include any and all polynucleotides which (i) encode proteins that are substantially identical to the surface lipoprotein sequences set forth herein; or (ii) hybridize to any surface lipoprotein polynucleotides set forth herein under at least moderately stringent hybridization conditions or which would hybridize thereto under at least moderately stringent conditions but for the use of synonymous codons.

The terms “polynucleotide encoding TbpB”, “a polynucleotide encoding a TbpB protein” and “polynucleotide encoding a TbpB polypeptide”, as may be used interchangeably herein, refer to any and all polynucleotides encoding a TbpB protein, including any TbpB protein, including the polynucleotide set forth in SEQ ID NO: 1147. Polynucleotides encoding a surface lipoprotein further include any and all polynucleotides which (i) encode proteins that are substantially identical to the surface lipoprotein sequences set forth herein; or (ii) hybridize to any surface lipoprotein polynucleotides set forth herein under at least moderately stringent hybridization conditions or which would hybridize thereto under at least moderately stringent conditions but for the use of synonymous codons.

The terms “polynucleotide encoding LbpB”, “a polynucleotide encoding a LbpB protein” and “polynucleotide encoding a LbpB polypeptide”, as may be used interchangeably herein, refer to any and all polynucleotides encoding a LbpB protein, including any LbpB protein, including the polynucleotide set forth in SEQ ID NO: 869. Polynucleotides encoding a surface lipoprotein further include any and all polynucleotides which (i) encode proteins that are substantially identical to the surface lipoprotein sequences set forth herein; or (ii) hybridize to any surface lipoprotein polynucleotides set forth herein under at least moderately stringent hybridization conditions or which would hybridize thereto under at least moderately stringent conditions but for the use of synonymous codons.

The terms "polynucleotide encoding fHbp", "a polynucleotide encoding a fHbp protein" and "polynucleotide encoding a fHbp polypeptide", as may be used interchangeably herein, refer to any and all polynucleotides encoding a fHbp protein, including any fHbp protein, including the polynucleotide set forth in SEQ ID NO: 1115. Polynucleotides encoding a surface lipoprotein further include any and all polynucleotides which (i) encode proteins that are substantially identical to the surface lipoprotein sequences set forth herein; or (ii) hybridize to any surface lipoprotein polynucleotides set forth herein under at least moderately stringent hybridization conditions or which would hybridize thereto under at least moderately stringent conditions but for the use of synonymous codons.

The terms "polynucleotide encoding HpuA", "a polynucleotide encoding a HpuA protein" and "polynucleotide encoding a HpuA polypeptide", as may be used interchangeably herein, refer to any and all polynucleotides encoding a HpuA protein, including any HpuA protein, including the polynucleotide set forth in SEQ ID NO: 931. Polynucleotides encoding a surface lipoprotein further include any and all polynucleotides which (i) encode proteins that are substantially identical to the surface lipoprotein sequences set forth herein; or (ii) hybridize to any surface lipoprotein polynucleotides set forth herein under at least moderately stringent hybridization conditions or which would hybridize thereto under at least moderately stringent conditions but for the use of synonymous codons.

By the term "substantially identical" it is meant that two polypeptide sequences preferably are at least 50% identical, and more preferably are at least 85% identical and most preferably at least 95% identical, for example 96%, 97%, 98% or 99% identical. In order to determine the percentage of identity between two polypeptide sequences the amino acid sequences of such two sequences are aligned, using for example the alignment method of Needleman and Wunsch (Needleman S B, Wunsch C D. 1970. A general method applicable to the search for similarities in the amino acid sequence of two proteins. Journal of molecular biology 48:443-453), as revised by Smith and Waterman (Smith TFaMSW. 1981. Comparison of Biosequences. Advances in Applied Mathematics 2:482-489) so that the highest order match is obtained between the two sequences and the number of identical amino acids is determined between the two sequences. A preferred, broadly applicable, method for accurately aligning two polypeptides involves the Clustal W algorithm (Thompson J D, Higgins D G, Gibson T J. 1994. CLUSTAL W: improving the sensitivity of progressive multiple sequence alignment through sequence weighting, position-specific gap penalties and weight matrix choice. Nucleic acids research 22:4673-4680.), employed with the BLOSUM 62 scoring matrix (Henikoff S, Henikoff J G. 1992. Amino acid substitution matrices from protein blocks. Proc Natl Acad Sci USA 89:10915-10919) using a gap opening penalty of 10 and a gap extension penalty of 0.1. This enables identification of high scoring alignments between two sequences, wherein at least 50% of the total length of one of the two sequences is involved in the alignment. Methods to calculate the percentage identity between two aligned amino acid sequences are generally art recognized and include, for example, those described by Carillo and Lipton (Carrillo H, and D. Lipman. 1989. The Multiple Sequence Alignment Problem in Biology. SIAM Journal on Applied Mathematics 48:1073-1082), and those described in Computational Molecular Biology, Lesk, e.d. Oxford University Press, New York, 1988, Biocomputing: Informatics and Genomics Projects. Generally, computer programs will be employed for such calculations. Computer programs that may be used in this regard include, but are not limited to, GCG (Devereux J, Haeberli P, Smithies O. 1984. A comprehensive set of sequence analysis programs for the VAX. Nucleic acids research 12:387-395), BLASTP, BLASTN and FASTA (Altschul S F, Gish W, Miller W, Myers E W, Lipman D J. 1990. Basic local alignment search tool. Journal of Molecular Biology 215:403-410).

By "at least moderately stringent hybridization conditions" it is meant that conditions are selected which promote selective hybridization between two complementary nucleic acid molecules in solution. Hybridization may occur to all or a portion of a nucleic acid sequence molecule. The hybridizing portion is typically at least 15 (e.g. 20, 25, 30, 40 or 50) nucleotides in length. Those skilled in the art will recognize that the stability of a nucleic acid duplex, or hybrids, is determined by the Tm, which in sodium containing buffers is a function of the sodium ion concentration and temperature (Tm=81.5° C.−16.6 (Log 10 [Na+])+0.41(%(G+C)−600/l), or similar equation). Accordingly, the parameters in the wash conditions that determine hybrid stability are sodium ion concentration and temperature. In order to identify molecules that are similar, but not identical, to a known nucleic acid molecule a 1% mismatch may be assumed to result in about a 1° C. decrease in Tm, for example if nucleic acid molecules are sought that have a >95% identity, the final wash temperature will be reduced by about 5° C. Based on these considerations those skilled in the art will be able to readily select appropriate hybridization conditions. In preferred embodiments, stringent hybridization conditions are selected. By way of example the following conditions may be employed to achieve stringent hybridization: hybridization at 5× sodium chloride/sodium citrate (SSC)/5×Denhardt's solution/1.0% SDS at Tm (based on the above equation) −5° C., followed by a wash of 0.2×SSC/0.1% SDS at 60° C. Moderately stringent hybridization conditions include a washing step in 3×SSC at 42° C. It is understood however that equivalent stringencies may be achieved using alternative buffers, salts and temperatures. Additional guidance regarding hybridization conditions may be found in: Green and Sambrook, Molecular Cloning, a Laboratory Manual, Cold Spring Harbor Laboratory Press, 2012 (32).

The term "chimeric" as used herein in the context of polynucleotides refers to at least two linked polynucleotides which are not naturally linked. Chimeric nucleic polynucleotides include linked polynucleotides of different natural origins. For example, a polynucleotide constituting an *E. coli* bacterial promoter linked to a polynucleotide encoding a *Neisseria* SLAM polypeptide is considered chimeric. In addition chimeric polynucleotides may have the same natural origin but are not naturally linked. Furthermore, non-naturally occurring polynucleotide vectors are chimeric. For example, a polynucleotide constituting a promoter obtained from a particular cell-type may be linked to a polynucleotide encoding a polypeptide obtained from that same cell-type, but not normally linked to the polynucleotide constituting the promoter. Chimeric polynucleotides also include polynucleotides comprising any naturally occurring polynucleotide linked to any non-naturally occurring polynucleotide.

The term "cytosol", as used herein, refers to the internal, generally aqueous portion of a cell, e.g. a bacterial cell, and includes all cellular components that may be present within the cytosol, but specifically excludes the extracellular surface of the cell.

The term "extracellular surface", as used herein, is intended to refer to a cellular surface structure of a cell separating the cytosolic portion of the cell from its exogenous environment. The cellular surface structure can include one or more phospholipid membranes with proteins and/or lipopolysaccharides embedded therein.

The term "host organism", as used herein, refers to human and non-human vertebrate animals, including, without limitation, bovine, porcine, equine, murine, canine, feline, piscine, ovine, hircine, simian and avian animals.

The terms "immunogen" and "immunogenic composition", as interchangeably used herein, are used in their broadest sense to refer to a molecule which contains one or more epitopes that will stimulate the immune response in a host organism to generate a cellular immunogen-specific immune response, or a humoral antibody response. Immunogens include proteins, polypeptides, peptides and immunogenic protein fragments.

The terms "vaccine" and "vaccine composition", as interchangeably used herein, refer to any pharmaceutical composition containing an immunogen, which composition can be used to prevent or treat a disease or condition in a host organism. The terms thus encompass subunit vaccines, i.e., vaccine compositions containing immunogens which are separate and discrete from a whole organism with which the immunogen is associated in nature, and further includes live vaccines.

It should be noted that terms of degree such as "substantially", "essentially" "about" and "approximately" as used herein mean a reasonable amount of deviation of the modified term such that the end result is not significantly changed. These terms of degree should be construed as including a deviation of the modified term if this deviation would not negate the meaning of the term it modifies.

As used herein, the wording "and/or" is intended to represent an inclusive-or. That is, "X and/or Y" is intended to mean X or Y or both, for example. As a further example, "X, Y, and/or Z" is intended to mean X or Y or Z or any combination thereof.

As used in this specification and the appended claims, the singular forms "a", "an", and "the" include plural referents unless the content clearly dictates otherwise. Thus, for example, reference to "an immunogen" includes a mixture of two or more such agents, reference to "a polypeptide" includes reference to mixtures of two or more polypeptides, reference to "a cell" includes two or more such cells, and the like.

General Implementation

As hereinbefore mentioned, the present disclosure relates to polypeptides and polynucleotides obtainable or obtained from Gram-negative bacterial species, notably polypeptides belonging to a class of proteins known as surface lipoprotein assembly modulators or SLAM proteins.

The polynucleotides encoding SLAM proteins of the present disclosure can be used for expression and production of SLAM proteins in host cells. Such expression of SLAM proteins in host cells, surprisingly, can result in the translocation of another protein, referred herein as the target protein, which is present in the host cell from the cytosolic portion of the host cell to the extracellular surface of the host cell.

Furthermore, the polynucleotides encoding SLAM proteins can be used to prepare vaccine formulations useful for the prevention of infections by pathogenic bacterial species, for example, bacterial species belonging to the genus *Neisseria.*

Furthermore, the polynucleotides encoding SLAM proteins and SLAM proteins can be used in assays to identify chemical compounds useful in the treatment of patients infected by pathogenic bacterial species.

Accordingly, in one aspect, the present disclosure provides, in at least one embodiment, a method of effecting transport of a target protein from the cytosol to the extracellular surface of a host cell comprising the target protein, the method comprising:

(a) providing a chimeric polynucleotide comprising as operably linked components:
  (i) a polynucleotide capable of controlling expression in the host cell; and
  (ii) a polynucleotide encoding a SLAM polypeptide; and
(b) introducing the chimeric nucleic acid sequence in the host cell and growing the host cell to produce the SLAM polypeptide, thereby effecting transport of the target protein from the cytosol to the extracellular surface of the host cell.

The polynucleotides encoding SLAM polypeptides in accordance herewith can be obtained from any bacterial species or strain comprising polynucleotides encoding SLAM proteins, including, in particular, any Gram negative bacterial species, including any bacterial species belonging to the phylum of proteobacteria, and further including any bacterial species belonging to the class of alpha-proteobacteria, beta-proteobacteria, gamma-proteobacteria and delta-proteobacteria.

Figure 8:
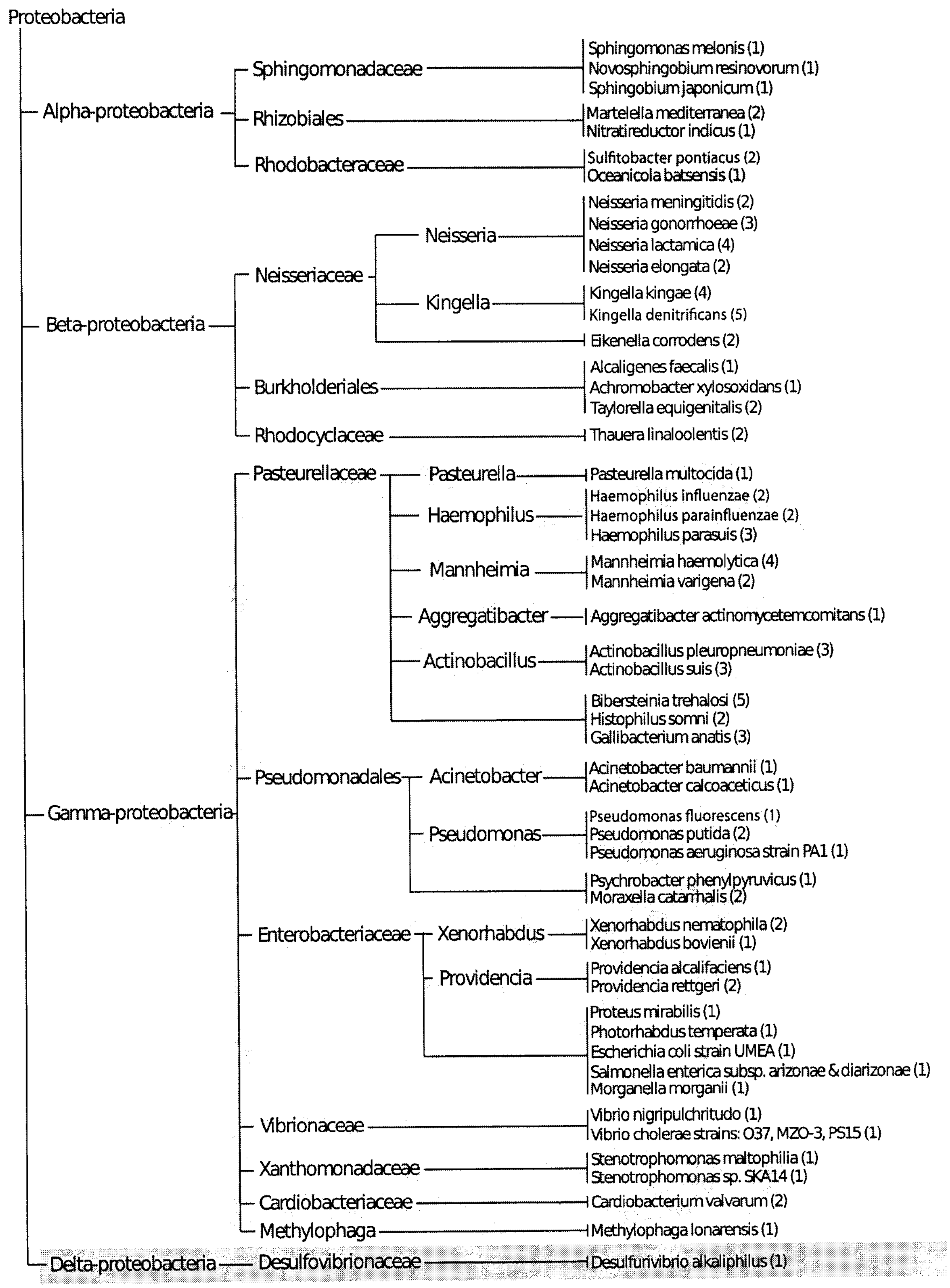
FIG. 8 shows a phylogenetic tree comprising exemplary microorganisms which may be used in accordance with the present disclosure. The predicted number of SLAM proteins in the noted bacterial species are shown in parenthesis.
Figure 9:
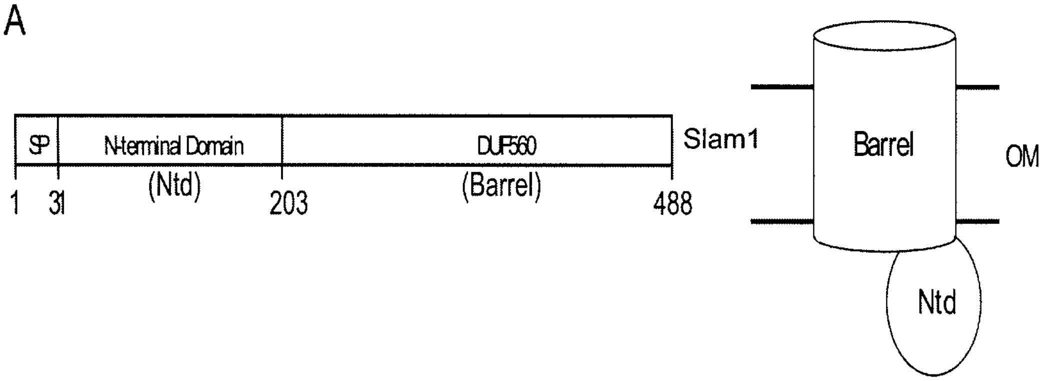
FIG. 9 shows the existence of SLAM family proteins across Gram-negative bacterial species.
Figure 9:
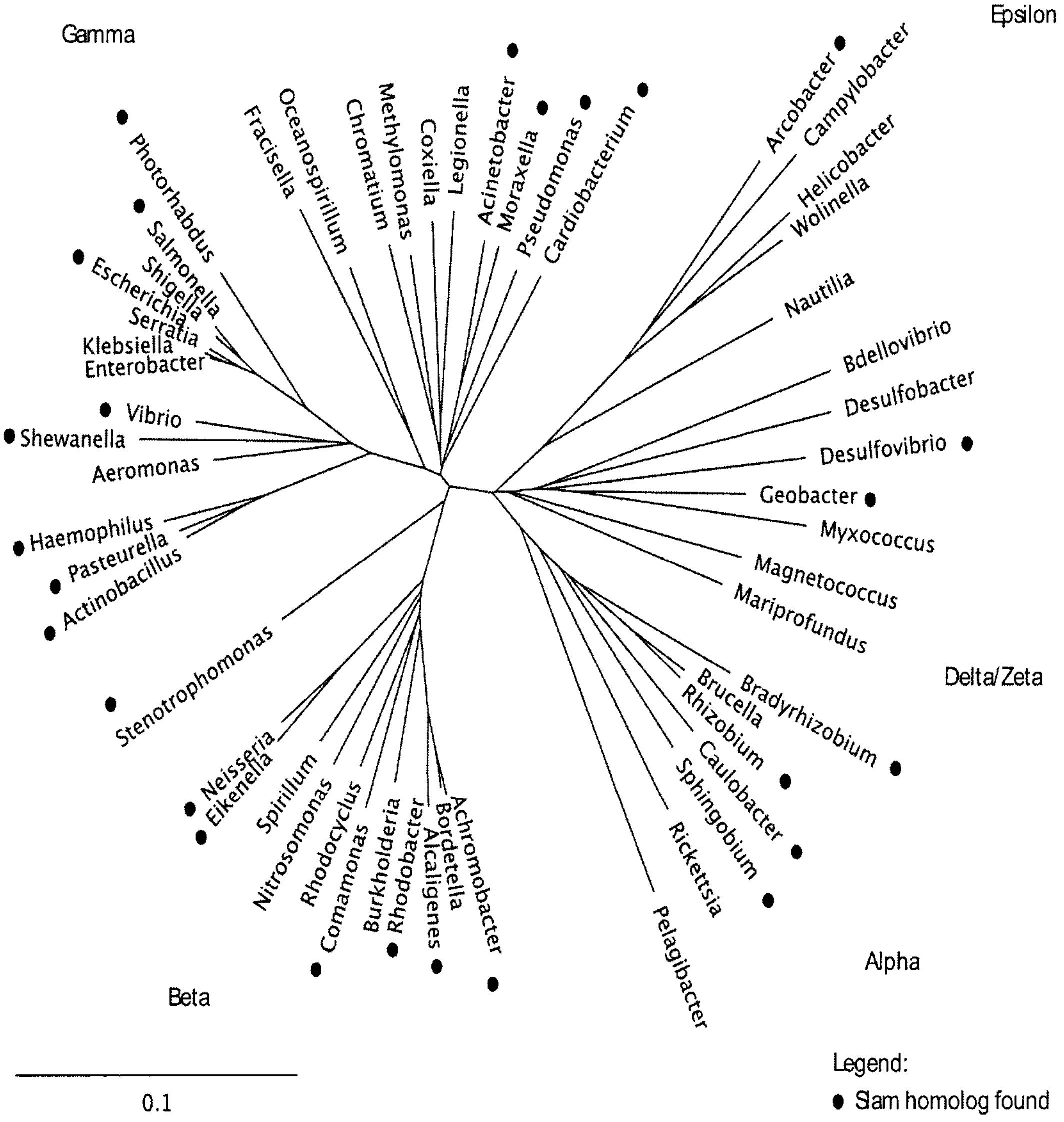

In some embodiments, the polynucleotides encoding SLAM polypeptides can be obtained from bacterial species belonging to a family within the alpha-proteobacteria, for example the families of Sphingomonadaceae, Rhizobiales and Rhodobacteraceae. Exemplary bacterial genera and species within each of these families are all of the species provided in FIG. 8 and FIG. 9.

In some embodiments, the polynucleotides encoding SLAM polypeptides can be obtained from bacterial species belonging to a family within the beta-proteobacteria, for example the families of Neisseriaceae, Burholderiales and Rhodocyclaceae. Exemplary bacterial genera and species within each of these families are all of the species provided in FIG. 8 and FIG. 9.

In some embodiments, the polynucleotides encoding SLAM polypeptides can be obtained from bacterial species belonging to a family within the gamma-proteobacteria, for example the families of Pasteurellaceae, Pseudomonodales, Enterobacteriaceae, Vibrionaceae, Xanthomonadaceae, Cardiobacteriaceae and methylophaga. Exemplary bacterial genera and species within each of these families are all of the species provided in FIG. 8 and FIG. 9.

In some embodiments, the polynucleotides encoding SLAM polypeptides can be obtained from bacterial species belonging to a family within the delta-proteobacteria, for example the family of Desulfovibrionaceae. An exemplary bacterial genus and species within this family is provided in FIG. 8 and FIG. 9.

In some embodiments, the polynucleotides encoding SLAM polypeptides can be obtained from a bacterial species belonging to the species *Neisseria meningitidis, Neisseria gonorrhoeae, Neisseria lactamica, Neisseria cincera, Klebsiella denitrificans, Moraxella catarrhalis, Mannheimia haemolytica, Actinobacillus pleuropneomoniae, Haemophilus somni, Haemophilus influenzae, Pasteurella multocida, Acinetobacter baumannii* or *Vibrio cholerae.*

In some embodiments, the polynucleotides encoding SLAM polypeptides are the polynucleotides comprising or consisting of any one of the odd-numbered SEQ ID NOs set forth herein starting from SEQ ID NO: 1 and ending at and including SEQ ID NO: 693.

In some embodiments, the SLAM polypeptides are polypeptides comprising or consisting of any of the even-numbered SEQ ID NOs starting from SEQ ID NO: 2 and ending at and including SEQ ID NO: 694

In accordance with some aspects of the present disclosure, the polynucleotide encoding the SLAM polypeptide is linked to a polynucleotide capable of controlling expression of the SLAM polypeptide in a host cell. The host cell can be any cell, including any eukaryotic cell, including an animal cell or plant cell, or microbial cell, such as a fungal cell or a bacterial cell.

In some embodiments, the host cell is a bacterial cell.

In some embodiments, the host cell is a Gram-negative bacterial cell.

In some embodiments, the host cell is a cell selected from bacterial cells belonging to the genus *Neisseria, Klebsiella, Moraxella, Mannheimia, Actinobacillus, Haemophilus, Pasteurella, Acinetobacter, Escherichia* or *Vibrio.*

In some embodiments, the host cell is selected from bacterial cells belonging to the species, *Neisseria meningitidis, Neisseria gonorrhoeae, Neisseria lactamica, Neisseria cincera, Klebsiella denitrificans, Moraxella catarrhalis, Mannheimia haemolytica, Actinobacillus pleuropneomoniae, Haemophilus somni, Haemophilus influenzae, Pasteurella multocida, Acinetobacter baumannii* or *Vibrio cholerae.*

In preferred embodiments, the host cell is selected from bacterial cells belonging to the genus *Neisseria*, including *Neisseria meningitidis* and *Neisseria gonorrhoeae*, or *Escherichia coli.*

In accordance with one aspect of the present disclosure, a polynucleotide capable of controlling expression in a host cell is linked to a polynucleotide encoding a SLAM polypeptide. Thus, in one aspect, the present disclosure further provides, in at least one embodiment, a polynucleotide encoding a SLAM polypeptide linked to a polynucleotide capable of controlling expression in a host cell.

Polynucleotides capable of controlling expression in host cells that can be used herein include any transcriptional promoter capable of controlling expression of polypeptides in host cells. Generally, promoters obtained from microbial cells are used when a microbial host is selected in accordance herewith, while a eukaryotic promoter is selected when a eukaryotic host is selected, and so on. Further polynucleotide components capable of controlling expression in a host cell include transcriptional terminators, enhancers and the like, all of which may be included in the chimeric polynucleotides of the present disclosure.

Figure 11:
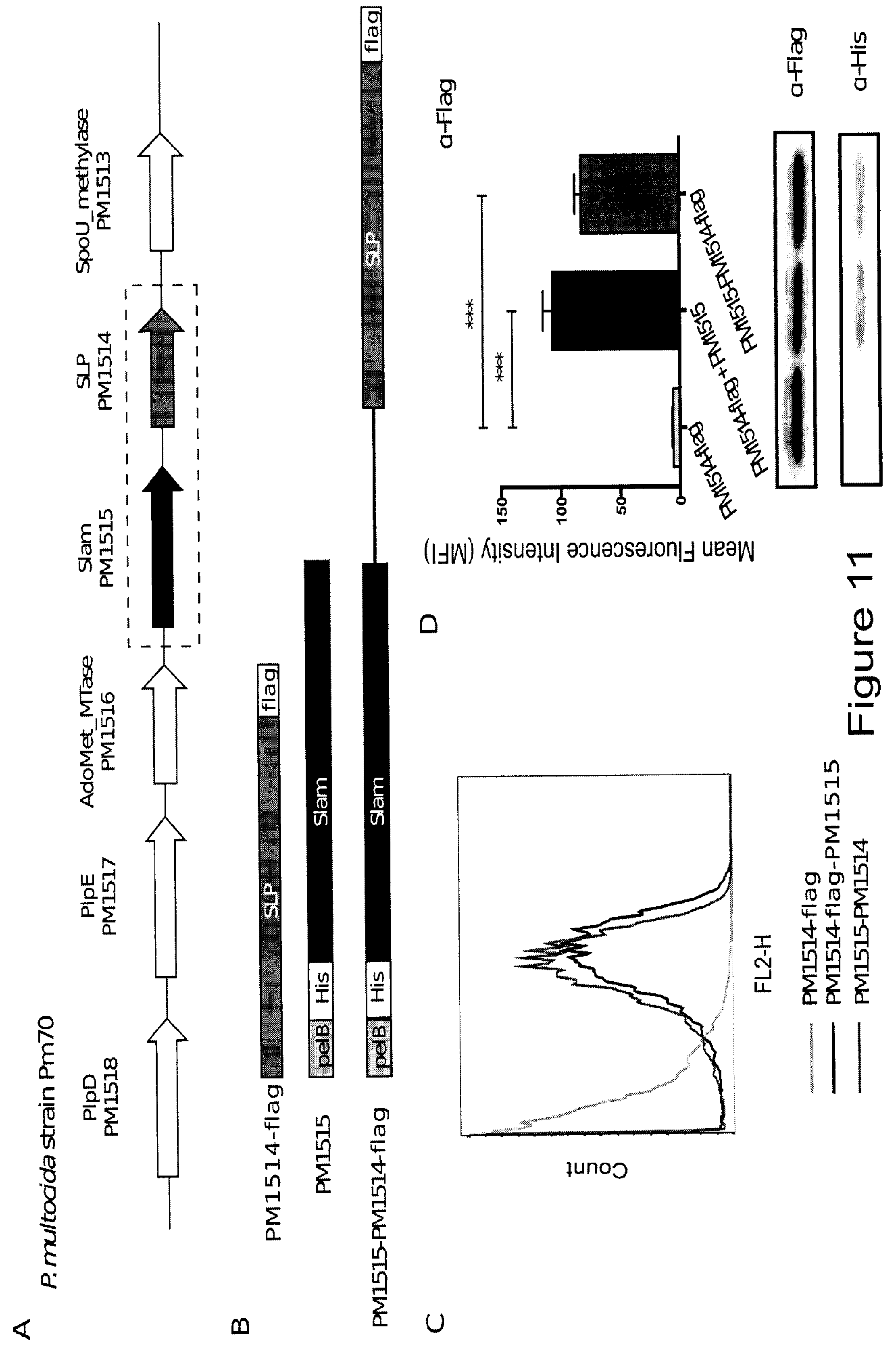
FIG. 11 shows the identification of a SLAM-dependent surface lipoprotein in *Pasteurella multocida*.
Figure 13:
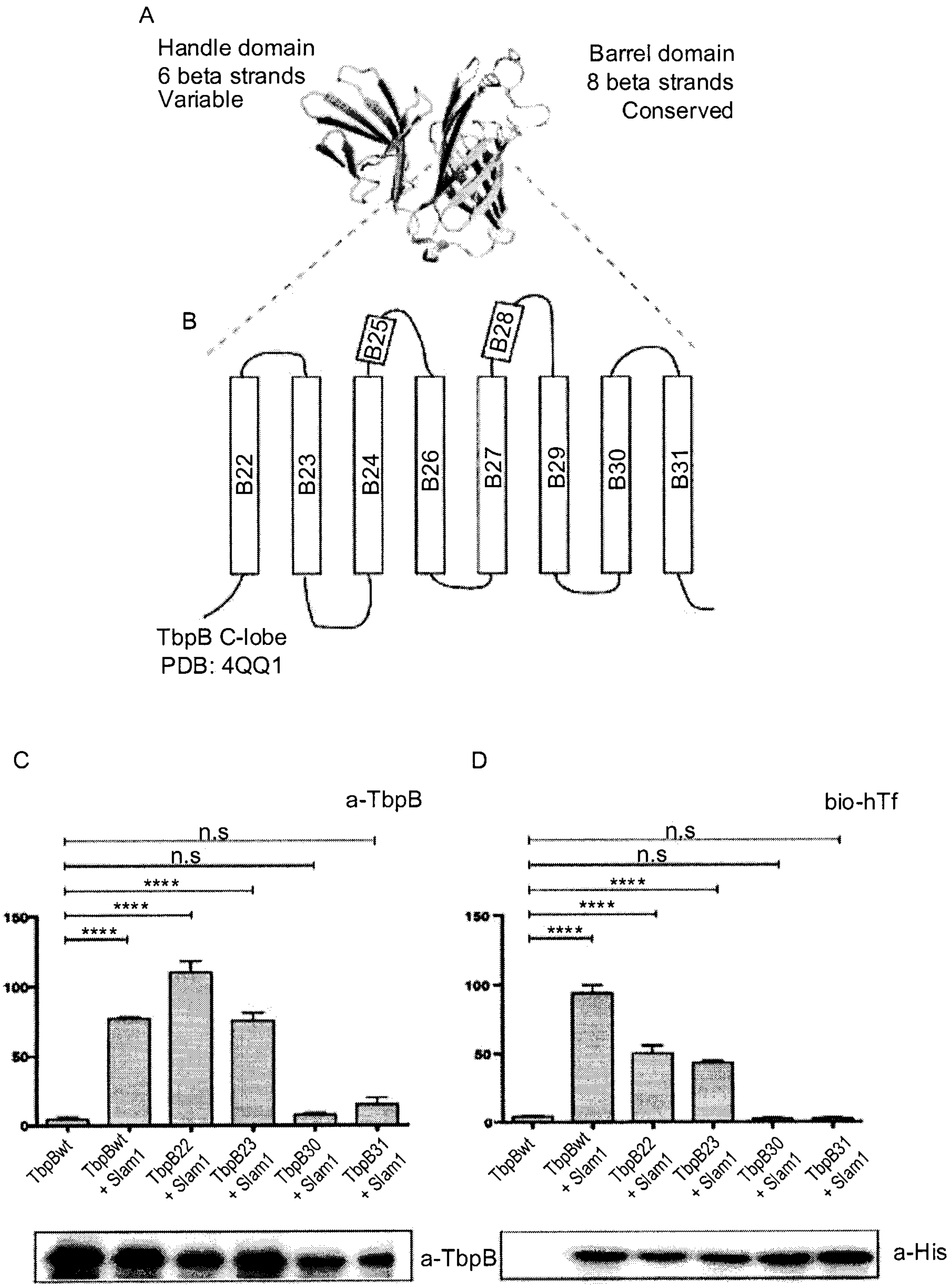
FIG. 13 shows that two of the C-terminal strands of SLAM-dependent surface lipoproteins are conserved and necessary for surface display.
Figure 13:
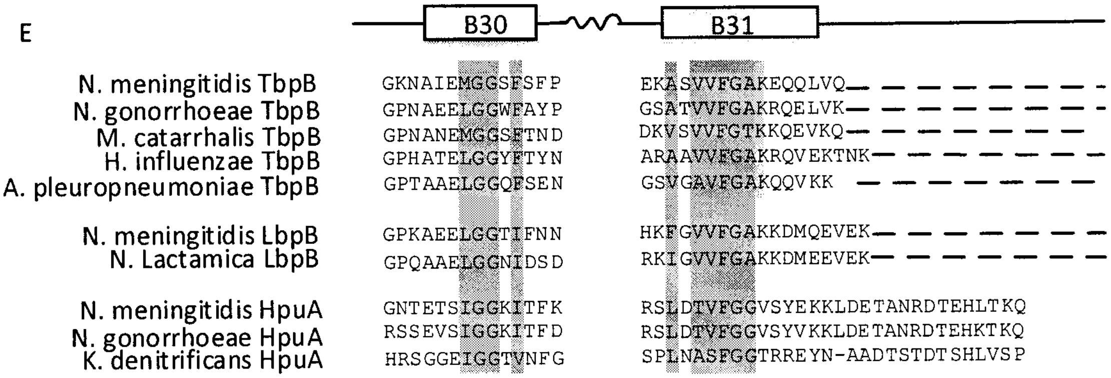
Figure 13:
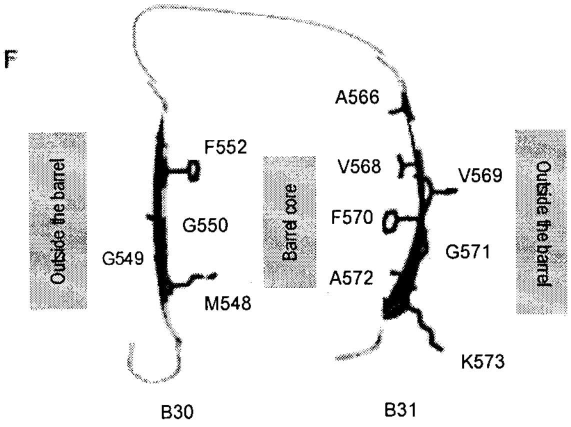

In accordance with the present disclosure, the chimeric polynucleotides of the present disclosure are preferably included in an expression vector which ensures good expression of the SLAM polypeptide in the host cell. Accordingly, the present disclosure includes, in one embodiment, a recombinant expression vector comprising as operably linked components:

(i) a polynucleotide capable of controlling expression in a host cell; and (ii) a polynucleotide encoding a SLAM polypeptide wherein the expression vector is suitable for expression in a host cell. The term "suitable for expression in a host cell" means that the recombinant expression vector comprises the chimeric nucleic acid sequence of the present disclosure linked to genetic elements required to achieve expression in a host cell. Genetic elements that can be included in the expression vector in this regard include a transcriptional termination region, one or more nucleic acid sequences encoding marker genes, one or more origins of replication, and the like. The genetic elements are operably linked, typically as will be known to those of skill in the art, by linking e.g. a promoter in the 5' to 3' direction of transcription to a coding sequence. In preferred embodiments, the expression vector further comprises genetic elements required for the integration of the vector or a portion thereof in the host cell's genome. Pursuant to the present disclosure the expression vector can further contain a marker gene. Marker genes that can be used in accordance with the present disclosure include all genes that allow the distinction of transformed cells from non-transformed cells, including all selectable and screenable marker genes. A marker gene can be a resistance marker such as an antibiotic resistance marker against, for example, kanamycin or ampicillin. Screenable markers that can be employed to identify transformants through visual inspection include, for example, β-galactosidase, β-glucuronidase (GUS) (U.S. Pat. Nos. 5,268,463 and 5,599,670) and green fluorescent protein (GFP) (Niedz R P, Sussman M R, Satterlee J S. 1995. Green Fluorescent Protein—an in-Vivo Reporter of Plant Gene-Expression. Plant Cell Rep 14:403-406), or other protein tags, for example a poly-histidine tag or a Flag tag, as shown in FIG. 11 and FIG. 13.

In accordance with one aspect of the present disclosure, the naturally occurring polynucleotides encoding SLAM can be modified. Thus the naturally occurring polynucleotides can be modified in order to enhance expression of the SLAM polypeptide in a host cell, for example by codon-optimizing the polynucleotide sequence encoding a SLAM polypeptide. Accordingly, the present disclosure further provides a codon optimized polynucleotide encoding a SLAM polypeptide, including the polynucleotide set forth in SEQ ID NO: 1113. The polynucleotide encoding SLAM can further be modified to include a signal sequence to facilitate expression. An exemplary polynucleotide encoding a signal sequence is set forth in SEQ ID NO: 1179, and the corresponding polypeptide signal sequence is set forth in SEQ ID NO: 1180. Thus the present disclosure further includes a chimeric polynucleotide encoding a microbial signal sequence operably linked to a polynucleotide encoding a SLAM polypeptide, as well as the polypeptides encoded by such polynucleotides, including the polynucleotides and polypeptides set forth in SEQ ID NO: 1181 and SEQ ID NO: 1182

One host cell that particularly conveniently can be used is *Escherichia coli*. The preparation of *E. coli* vectors can be accomplished using commonly known techniques such as restriction digestion, ligation, ligation-independent cloning, gel electrophoresis, DNA sequencing, the Polymerase Chain Reaction (PCR), and other methodologies. A wide variety of cloning vectors are available to perform the necessary steps required to prepare a recombinant expression vector including custom vectors that the inventors have developed. Among the vectors with a replication system functional in *E. coli*, are vectors such as the pUC or pET series of vectors, etc. Typically, these cloning vectors contain a marker allowing selection of transformed cells. Polynucleotides can be introduced in these vectors, using for example restriction and ligation enzymes, and the vectors may be introduced in *E. coli* by preparing competent cells, electroporation or using other well known methodologies to a person of skill in the art. *E. coli* can be grown in an appropriate medium, such as Luria-Broth medium and harvested. Recombinant expression vectors may readily be recovered from cells upon harvesting and lysing of the cells. Further, general guidance with respect to the preparation of recombinant vectors and growth of recombinant organisms can be found in, for example: Sambrook et al., Molecular Cloning, a Laboratory Manual, Cold Spring Harbor Laboratory Press, 2001, Third Ed.

The production of the recombinant SLAM polypeptides can occur throughout the growth of the bacterial strain, or can be achieved by induction of expression, using e.g. an inducible promoter, such as the lacZ promoter, after a period of growth to achieve a significant biomass.

In accordance herewith, in some embodiments, the SLAM polypeptide subsequently is recovered, isolated and separated from other host cell components. Thus the present disclosure, in a further embodiment, provides a method of expressing a SLAM polypeptide in a host cell comprising:

(a) providing a chimeric polynucleotide comprising as operably linked components:
   (i) a polynucleotide capable of controlling expression in the host cell; and
   (ii) a polynucleotide encoding a SLAM polypeptide; and
(b) introducing the chimeric nucleic acid sequence in the host cell and growing the host cell to produce the SLAM polypeptide; and
(c) recovering the SLAM polypeptide from the host cell.

SLAM protein recovery can be effected by a variety of different protein purification techniques including, e.g. metal-chelate chromatography, ion-exchange chromatography, size exclusion chromatography, affinity chromatography, hydrophobic interaction chromatography, reverse phase chromatography, gel filtration, etc. Further general guidance with respect to protein purification may for example be found in: Protein Purification: Principles, High Resolution Methods, and Applications Janson J-C. 2013. Protein Purification: Principles, High Resolution Methods, and Application, vol. 54. Wiley. The term "recovered" as used herein means that the polypeptide is obtained in more or less pure form. By "substantially pure" it is meant that the immunogenic protein is separated from other host cell components. In accordance here with the immunogenic protein is at least 95% pure, and more preferably at least 96%, 97%, 98% or 99% pure.

In another aspect, the present disclosure relates to novel SLAM polypeptides. Accordingly the present disclosure provides, in at least one embodiment, a SLAM polypeptide comprising or consisting of SEQ ID NO: 1184, or a polypeptide substantially identical thereto.

In another aspect, the present disclosure relates to novel polynucleotides encoding SLAM polypeptides. Accordingly, the present disclosure provides, in at least one embodiment, a polynucleotide comprising or consisting of SEQ ID NO: 1183.

With respect to the host cell, the SLAM polypeptide can be a SLAM polypeptide naturally present therein, and thus in some embodiments, production of the SLAM polypeptide in the host cell can result in the modulation of the SLAM polypeptide protein concentration in the cells, for example, the concentration of SLAM polypeptide in the cell may increase as a result of the introduction of the chimeric polypeptide sequence. In other embodiments, the produced SLAM polypeptide is not naturally present in the host cells.

The target protein can be any protein, polypeptide or peptide, which can require transportation from the cytosol to the extracellular surface of a host cell. The term "extracellular surface", as used herein, is intended to refer to a cellular surface structure of a cell, separating the cytosolic portion of the cell from its exogenous environment. The cellular surface structure can include one or more phospholipid membranes with proteins and/or lipopolysaccharides embedded therein. In Gram-negative bacteria, the extracellular surface structure comprises an inner phospholipid bilayer membrane and an outer phospholipid bilayer membrane separated from one another by an aqueous periplasmic compartment. Upon transportation from the cytosol to the extracellular surface of the host cell, the target protein coordinates and interacts with the extracellular surface structure of the cell. Such interaction can lead to the exposure of at least a portion of the target protein to the exogenous environment of the cell.

In at least some embodiments, the target protein is an immunogenic protein capable of eliciting an immune response in a host organism.

In at least some embodiments, the target protein is an immunogenic polypeptide, or an immunogenic portion thereof, that is naturally displayed on the exterior surface of a pathogenic microorganism.

In at least some embodiments the immunogenic protein is a surface lipoprotein (SLP) or a portion thereof.

In at least some embodiments, the surface lipoprotein (SLP) comprises or consists of a polypeptide sequence or a portion thereof selected from one of the one of the even-numbered SEQ ID NOs: SEQ ID NO: 696 to SEQ ID NO: 1082, SEQ ID NO: 1094, SEQ ID NO: 1100 and even-numbered SEQ ID NOs: 1116 to SEQ ID NO: 1168, and SEQ ID NO; 1178 set forth herein.

In at least some embodiments, the surface lipoprotein (SLP) comprises or consists of a polypeptide sequence or a portion thereof encoded by a polynucleotide selected from one of the even-numbered SEQ ID NOs starting from SEQ ID NO: 695 and ending at and including SEQ ID NO: 1081 set forth herein.

In at least some embodiments, the target protein is a surface lipoprotein located on a bacterial genome adjacent to a polynucleotide sequence encoding a SLAM polypeptide.

In at least some embodiments, the immunogenic protein is a surface lipoprotein, or an immunogenic portion thereof, selected from the group consisting of a transferrin binding protein B (TbpB), including, in some embodiments, TbpB polypeptides comprising SEQ ID NO: 1148, a hemoglobin-haptoglobin binding protein A (HpuA), including, in some embodiments, HpuA polypeptides comprising SEQ ID NO: 932, a Factor H binding protein (fHbp), including, in some embodiments, fHbp polypeptides comprising SEQ ID NO: 1116 and a lactoferrin binding protein (LbpB), including, in some embodiments, LbpB polypeptides comprising SEQ ID NO: 1138.

In at least some embodiments, the transferrin binding protein B (TbpB) is encoded by a polynucleotide sequence comprising or consisting of SEQ ID NO: 1149.

In at least some embodiments, the lactoferrin binding protein B (LbpB) is encoded by a polynucleotide sequence comprising or consisting of SEQ ID NO: 869.

In at least some embodiments, the factor H binding protein (fHbp) is encoded by a polynucleotide sequence comprising or consisting of SEQ ID NO: 1115.

In at least some embodiments, the hemoglobin-haptoglobin binding protein A (HpuA) is encoded by a polynucleotide sequence comprising or consisting of SEQ ID NO: 923.

In at least some embodiments, the target protein is a fusion protein comprising two or more surface lipoproteins or portions thereof. In some embodiments, the target protein is a fusion protein comprising two or polypeptides, or portions thereof, obtained from at least two of the lipoproteins selected from SEQ ID NOs: SEQ ID NO: 696 to SEQ ID NO: 1082, and SEQ ID NO: 1178 set forth herein. In further embodiments, the target protein is fusion polypeptide comprising a portion obtained from at least two of a transferrin binding protein (TbpB), a lactoferrin binding protein (LbpB), a factor H binding protein (fHbp) and hemoglobin-haptoglobin binding protein (HpuA). In some embodiments, the target protein is a fusion polypeptide comprising a first surface lipoprotein fused, at the N-terminal end or at the C-terminal end, to an immunogenic portion a second surface lipoprotein. In a specific embodiment, the target protein is the fusion polypeptide set forth in SEQ ID NO: 1102. The implementation of the use of a fusion polypeptide as a target protein in accordance with the present disclosure is further illustrated in Example 9.

In general, in embodiments hereof where a portion of a TbpB peptide is used, such portion comprises at least (i) a TbpB signal peptide lipo-box, including an anchoring peptide (SEQ ID NO: 1170), and/or (ii) the C-terminal domain of the TbpB polypeptide (SEQ ID NO: 1098).

While a substantial number of target proteins are provided in the present disclosure, new target proteins can be discovered and used in accordance with the present disclosure without departing from the spirit of the present disclosure. Thus the present disclosure is not intended to be limited with respect to the target protein and any target protein can be used in order to carry out the novel methods of the present disclosure. In one embodiment, in order to discover new target proteins, the genomic regions immediately adjacent to a genomic region encoding a SLAM polypeptide can be probed for the presence of polynucleotide sequences encoding polypeptides, and any identified polypeptides can be evaluated as target proteins. Accordingly, in yet another aspect, the present disclosure provides, in at least one embodiment, a method for identifying a target protein capable of being transported by a SLAM polypeptide from the cytosol to the extracellular surface of a cell, the method comprising:

(a) providing a genomic nucleotide sequence comprising
  (i) a first nucleotide sequence encoding a SLAM polypeptide; and
  (ii) a second nucleotide sequence sufficiently long to encode a polypeptide and naturally attached to the first nucleotide sequence;
(b) evaluating the second nucleotide sequence to identify a polypeptide encoding sequence within the second nucleotide sequence; and
(c) using the polypeptide encoding sequence to express the polypeptide in a host cell comprising a SLAM polypeptide to determine whether the protein is transported from the cytosol to the extracellular surface of the host cell, to thereby identify whether the protein is a target protein.

In accordance with the foregoing any genomic nucleotide sequence encoding a SLAM polypeptide can be provided.

In some embodiments a genomic nucleotide sequence from any microbial genome, including, for example, the genomes of a bacterial species belonging to the genus *Neisseria, Klebsiella, Moraxella, Mannheimia, Actinobacillus, Haemophilus, Pasteurella, Acinetobacter, Escherichia* and *Vibrio* is provided. The genomic nucleotide sequence can vary in length and can represent an entire genome or portion or fragment thereof, provided however that the first and second nucleotide sequence are naturally attached, and provided further that the second nucleotide sequence is sufficiently long to comprise a nucleotide sequence encoding a polypeptide.

In some embodiments, the first nucleotide sequences comprises a sequence selected from any one of the odd-numbered SEQ ID NOs: SEQ ID NO 1 to SEQ ID NO: 695.

In general, the second nucleotide sequence, which can be attached on either side or both sides to first nucleotide sequence (i.e. 5' or 3' relative to the SLAM encoding sequence), extends at least 100 nucleotides from the first nucleotide sequence. The second nucleotide sequence can also be longer, for example, it can be at least 250 nucleotides, at least 500 nucleotides, at least 1,000 nucleotides, at least 2,000 nucleotides or at least 5,000 nucleotides in length. In some embodiments, the genomic nucleotide sequence is a visual representation of a nucleotide sequence present on a medium capable of visually displaying nucleotide sequence information, such as a computer screen, screen of a tablet or handheld device, or a print-out of the nucleotide sequence on paper. In order to obtain a genomic nucleotide sequence a polynucleotide can be provided upon isolation thereof from a microbial organism, and the sequence of the polynucleotide can be determined using techniques for nucleotide sequencing well known to the art, and the obtained nucleotide sequence can then be visually represented for evaluation. The nucleotide sequence can be evaluated and analyzed for the presence of open reading frames and coding regions polypeptide encoding sequences using techniques and methods well known to the art, including for example computer software capable of nucleic acid sequence translation such as ExPASy (Gasteiger, E.; Gattiker, A; Hoogland, C; Ivanyi, I; Appel, R D; Bairoch, A (2003). "ExPASy: The proteomics server for in-depth protein knowledge and analysis". Nucleic Acids Research. 31 (13): 3784-8). Upon the identification of a polypeptide encoding sequence within the second nucleic acid, genetic constructs including the polypeptide encoding sequence can be prepared and used for expression in a host cell to determine whether the polypeptide is transported from the cytosol to the extracellular surface of the host cell. Genetic constructs can be prepared by isolating the polypeptide encoding nucleotide sequence from its natural source microbial organism, and introducing it in an expression vector suitable for expression in a host cell. In some embodiments, the polypeptide encoding nucleotide sequence comprises or consists of the genomic nucleotide sequence. The expression vector, in turn, can be introduced into a host cell. The host cell is a cell comprising a SLAM polypeptide which can, in some embodiments, be naturally present therein or, in other embodiments, can be recombinantly expressed in the host cell. In embodiments wherein the polypeptide encoding nucleotide sequence comprises or consists of the genomic sequence, the polypeptide encoding nucleotide sequence and the nucleotide sequence encoding the SLAM polypeptide can be simultaneously introduced into the host cell. In some embodiments, the host cell is an *Escherichia coli* cell. In the event the polypeptide, upon growth of the host cell, and expression of the target protein in the host cell, is transported to the extracellular surface of the host cell to associate with the extracellular surface, the polypeptide is a target protein.

The foregoing embodiment of the present disclosure is further illustrated in Example 8 and 10 below.

In at least some embodiments, the target protein is naturally present in the host cell. Accordingly, the present disclosure further comprises a method of effecting transport of a target protein naturally present in the host cell from the cytosol to the extracellular surface of a host cell comprising:

(a) selecting a host cell comprising a target protein naturally present in the cell;
(b) providing a chimeric polynucleotide comprising as operably linked components:
  (i) a polynucleotide capable of controlling expression in the host cell; and
  (ii) a polynucleotide encoding a SLAM polypeptide; and
(c) introducing the chimeric nucleic acid sequence in the host cell and growing the host cell to produce the SLAM polypeptide and effect transport of the target protein from the cytosol to the extracellular surface.

In at least at least some embodiments, the target protein is naturally present in a cell of a pathogenic bacterial species selected from the group of bacteria consisting of *Neisseria meningitidis, Neisseria gonorrhoeae, Neisseria lactamica, Neisseria cincera, Klebsiella denitrificans, Moraxella catarrhalis, Mannheimia haemolytica, Actinobacillus pleuropneomoniae, Haemophilus somni, Haemophilus influenzae, Pasteurella multocida, Acinetobacter baumannii* or *Vibrio cholerae.*

In at least some embodiments, the target protein interacts and coordinates with the SLAM polypeptide in a non-covalent manner. The non-covalent interaction between the SLAM polypeptide and the target protein can lead to the formation of a heterodimeric protein complex comprising the SLAM polypeptide and the target protein. The interaction can be a temporary interaction, e.g. for a period of time sufficiently long to permit transport the target polypeptide from the cytosol from the cytosol to the extracellular surface, or a more prolonged interaction wherein the non-covalent interaction between the SLAM polypeptide and the target protein remains upon transport of the target polypeptide to the extracellular membrane of the cell.

In at least some embodiments the target protein is not naturally present in the host cell. Accordingly, the present disclosure further provides, in at least one embodiment, a method of effecting transport of a target protein from the cytosol to the extracellular surface of a host cell comprising:

(a) providing a first chimeric polynucleotide comprising as operably linked components:
  (i) a polynucleotide capable of controlling expression in the host cell; and
  (ii) a polynucleotide encoding a SLAM polypeptide; and
(b) providing a second chimeric polynucleotide comprising as operably linked components:
  (i) a polynucleotide capable of controlling expression in the host cell; and
  (ii) a polynucleotide encoding a target protein; and
(b) introducing the first and second chimeric polynucleotide in the host cell and growing the host cell to produce the SLAM polypeptide and the target protein.

In at least some embodiments, the target protein is covalently linked to the SLAM polypeptide. Accordingly, the present disclosure provides, in at least one embodiment, a method of effecting transport of a target protein from the cytosol to the extracellular surface of a host cell comprising:

(a) providing a chimeric polynucleotide comprising as operably linked components:
  (i) a polynucleotide capable of controlling expression in the host cell;
  (ii) a polynucleotide encoding a SLAM polypeptide; and
  (iii) a polynucleotide encoding a target protein; and
(b) introducing the chimeric nucleic acid sequence in the host cell and growing the host cell to produce the SLAM polypeptide and effect transport of the target protein from the cytosol to the extracellular surface.

In at least some embodiments, the chimeric polynucleotide is constructed in a manner that results in covalent linking, preferably through a peptide bond, of the N-terminal end of a target protein to the C-terminal end of the SLAM polypeptide.

In at least some embodiments, the chimeric polynucleotide is constructed in a manner that results in the covalent linking, preferably through a peptide bond, of the N-terminal end of the SLAM polypeptide to the C-terminal end of the target protein.

In at least some embodiments the chimeric polynucleotide is constructed in a manner that results in the removal of a portion of the SLAM polypeptide and replacement thereof with the target polypeptide. In some embodiments, the chimeric polynucleotide is constructed in a manner that results removal of at least 1, 2, 3, 4, 5, 6, 7, 8, 9, or 10 amino acid residues of the N-terminal end of the SLAM polypeptide and replacement of such residue(s) with the target protein. In some embodiments, the chimeric polynucleotide is constructed in a manner that results in the removal of at least 1, 2, 3, 4, 5, 6, 7, 8, 9, or 10 amino acid residues of the C-terminal end of the SLAM polypeptide and replacement of the residue(s) with the target protein. In some embodiments, the chimeric polynucleotide is constructed in a manner that results in the insertion of the target protein within the polypeptide sequence of the SLAM polypeptide. In some embodiments, the chimeric polynucleotide is constructed in a manner that results in the insertion of the target protein within the SLAM polypeptide and the replacement of at least 1, 2, 3, 4, 5, 6, 7, 8, 9, or 10 amino acid residue(s) of the SLAM polypeptide by the target protein.

In at least some embodiments, the polynucleotide encoding the SLAM polypeptide can be substantially truncated. Notably the N-terminal portion of the SLAM polypeptide can be removed to obtain a truncated SLAM polypeptide consisting of only the C-terminal domain 8-barrel domain, consisting of 12-14 outer membrane spanning strands. An example of a truncated SLAM polypeptide that may be used in accordance herewith to effect transport of a target protein is set forth in SEQ ID. NO: 1111 and SEQ ID NO: 1112.

In accordance with another aspect hereof, the present disclosure provides, in certain embodiments, methods or preparing vaccines. Accordingly, the present disclosure further provides, in at least one embodiment, a method of preparing a vaccine comprising:

(a) selecting a host cell capable of producing an immunogen
(b) providing a chimeric polynucleotide comprising as operably linked components:
  (i) a polynucleotide capable of controlling expression in the host cell; and
  (ii) a polynucleotide encoding a SLAM polypeptide; and
(c) introducing the chimeric nucleic acid sequence in the host cell and growing the host cell to produce the SLAM polypeptide and the immunogen; and
(d) attenuating the host cell to prepare an attenuated host cell; and (e) preparing a vaccine formulation comprising the attenuated host cell.

In some embodiments, the host cell is a microbial cell.

In some embodiments, the host cell is a pathogenic microbial cell.

In some embodiments, the host cell is a pathogenic microbial cell mediating an infectious disease.

In at least one embodiment, the host cell is a cell selected from the group of cells consisting of *Neisseria meningitidis, Neisseria gonorrhoeae, Neisseria lactamica, Neisseria cincera, Klebsiella denitrificans, Moraxella catarrhalis, Mannheimia haemolytica, Actinobacillus pleuropneomoniae, Haemophilus somni, Haemophilus influenzae, Pasteurella multocida, Acinetobacter baumannii* and *Vibrio cholerae*. The immunogen may be naturally present in the host cell or it may be recombinantly expressed in the host cell. In order to achieve attenuation, the cells, upon production of the SLAM protein and the immunogen are treated in such a manner that they are no longer capable of infection. Typically this achieved by heat-killing of the bacterial cells or by creating outer membrane vesicles. Attenuation techniques will be generally known to those of skill in the art and can, for example, be found in: Vaccination with attenuated *Neisseria meningitidis* strains protects against challenge with live Meningococci. Li Y, Sun Y H, Ison C, Levine M M, Tang C M. Infect Immun. 2004 January; 72(1):345-51. Li Y, Zhang Q Winterbotham M, Mowe E, Gorringe A, Tang C M. Immunization with live *Neisseria lactamica* protects mice against meningococcal challenge and can elicit serum bactericidal antibodies. Infect Immun. 2006; 74(11):6348-55. Dalseg R, Wedege E, Holst J, Haugen I L, Høiby E A, Haneberg B. Outer membrane vesicles from group B meningococci are strongly immunogenic when given intranasally to mice. Vaccine. 1999; 17:2336-2345.

In at least some embodiments, the present disclosure provide a method of preparing a vaccine comprising:

(a) providing a first chimeric polynucleotide comprising as operably linked components:
  (i) a polynucleotide capable of controlling expression in the host cell;
  (ii) a polynucleotide encoding a SLAM polypeptide; and
(b) providing a second chimeric polynucleotide comprising as operably linked components:
  (i) a polynucleotide capable of controlling expression in the host cell; and
  (ii) a polynucleotide encoding a target protein; and
(c) introducing the first and second chimeric polynucleotide in the host cell and growing the host cell to produce the SLAM polypeptide and the target protein; and
(d) preparing a vaccine formulation comprising the cells of (c).

In at least some embodiments, the present disclosure provides a method of preparing a vaccine comprising:

(a) providing a chimeric polynucleotide comprising as operably linked components:
  (i) a polynucleotide capable of controlling expression in the host cell;
  (ii) a polynucleotide encoding a SLAM polypeptide; and
  (iii) a polynucleotide encoding a target protein; and
(b) introducing the chimeric polynucleotide in the host cell and growing the host cell to produce the SLAM polypeptide and the target protein; and
(c) preparing a vaccine formulation comprising the cells of (b).

In a at least some embodiments, present disclosure further provides a method of preparing a vaccine against a pathogenic bacterial infection comprising:

(a) providing a pathogenic bacterial strain comprising a nucleic acid sequence encoding a SLAM polypeptide;
(b) impairing SLAM production in the pathogenic strain to obtain a SLAM impaired pathogenic bacterial strain; and
(c) using the SLAM impaired pathogenic strain to formulate a vaccine.

In preferred embodiments, the pathogenic bacterial strain is a strain of *Neisseria meningitidis, Neisseria gonorrhoeae, Neisseria lactamica, Neisseria cincera, Klebsiella denitrificans, Moraxella catarrhalis, Mannheimia haemolytica, Actinobacillus pleuropneomoniae, Haemophilus somni, Haemophilus influenza, Pasteurella multocida, Acinetobacter baumannii* or *Vibrio cholera*.

In at least some embodiments the pathogenic bacterial strain is a bacterial strain belonging to the genus *Neisseria*. In accordance with the foregoing, any bacterial *Neisseria* strain can be used. In order to impair the *Neisseria* strain any methodology can be used. Preferably, a method which results in the attenuation or the knock-out of the genomic polynucleotide sequence encoding a SLAM polypeptide is used, for example by transposon mutagenesis. Thus in preferred embodiments a SLAM impaired *Neisseria* strain, is a *Neisseria* strain in which a genomic polynucleotide encoding SLAM polypeptide has been mutated in such a manner that no substantive amounts of SLAM polypeptide are produced, such mutation can include the removal of the a polynucleotide encoding a SLAM polypeptide.

In another aspect, the present disclosure provides, in at least one embodiment, a pathogenic bacterial strain comprising an impaired genomic SLAM polynucleotide sequence. With the term "strains comprising impaired genomic SLAM polynucleotide sequence", it is meant that a bacterial strain is not capable of producing substantive amounts of SLAM polypeptide. In some embodiments, the pathogenic bacterial strain is a *Neisseria* strain. This includes strains comprising polynucleotides in which the open reading frame has been interrupted, and strains regulating expression of SLAM proteins are not functional, and the term is further intended to include strains from which a genomic SLAM encoding polynucleotide sequence has been removed. Thus the disclosure further includes a mutant pathogenic bacterial strain lacking a genomic polynucleotide sequence encoding a SLAM polypeptide. In preferred embodiments, the mutated pathogenic bacterial strain is a *Neisseria* strain. In accordance with the foregoing, it is intended that the mutant strain lacks at least one genomic polynucleotide encoding a SLAM polypeptide when compared to the native strain. In preferred embodiments, the mutant *Neisseria* strain is a *Neisseria meningitidis* strain or a *Neisseria gonorrhoeae* strain.

In accordance with certain aspects of the present disclosure, a vaccine preparation is prepared. The vaccine can be used to administer to a host organism, including any human and non-human animal, including without limitation any bovine, porcine, equine, murine, canine, feline, piscine, ovine, hircine, simian and avian animals. Accordingly, in another aspect, the present disclosure provides, in at least one embodiment, a vaccine preparation prepared according to any of the methods of the present disclosure.

In another aspect, the present disclosure provides, in at least one embodiment, a use of a vaccine preparation made according to any of the methods of the present disclosure to immunize a host organism.

In some embodiments, the vaccine preparation can be used to immunize a host organism against an infectious disease mediated by a bacterial organism belonging to the genus, *Neisseria, Klebsiella, Moraxella, Actinobacillus, Haemophilus, Pasteurella, Acinetobacter* or *Vibrio cholerae.*

In some embodiments, the vaccine preparation can be used to immunize a host organism against an infectious disease mediated by a bacterial organism belonging to the species, *Neisseria meningitidis, Neisseria gonorrhoeae, Neisseria lactamica, Neisseria cincera, Klebsiella denitrificans, Moraxella catarrhalis, Mannheiia haemolytica, Actinobacillus pleuropneomoniae, Haemophilus somni, Haemophilus influenzae, Pasteurella multocida, Acinetobacter baumannii* or *Vibrio cholerae.*

In at least some embodiments, of the present disclosure, the vaccines, when administered to a human prevent infection by *Neisseria* bacteria, notably *Neisseria meningitidis* and *Neisseria gonorrhoeae*. In accordance here with vaccine formulations may be prepared using the cells prepared using the methods of the present disclosure. In some embodiments, the vaccine formulations can be prepared using attenuated cells. In other embodiments, the cells may be used as source from which certain fractions, for example a protein fraction or a membrane may be obtained and used to prepare a vaccine. Vaccine preparations of the present disclosure preferably further comprise vehicles, excipients and auxiliary substances, such as wetting or emulsifying agents, pH buffering substances and the like. These vehicles, excipients and auxiliary substances are generally pharmaceutical agents that do not induce an immune response in the recipient subject, and that can be administered without undue toxicity. Pharmaceutically acceptable excipients include, but are not limited to, liquids such as water, saline, polyethyleneglycol, hyaluronic acid, glycerol and ethanol. Pharmaceutically acceptable salts can also be included therein, for example, mineral acid salts such as hydrochlorides, phosphates, sulfates, and the like; and the salts of organic acids such as acetates, propionates, benzoates, and the like. It is also preferred, although not required, that the preparation will contain a pharmaceutically acceptable excipient that serves as a stabilizer, particularly in order to stabilize the polypeptides of the present disclosure. Examples of suitable carriers that also act as stabilizers for peptides include, without limitation, pharmaceutical grades of dextrose, sucrose, lactose, sorbitol, inositol, dextran, and the like. Other suitable carriers include, again without limitation, starch, cellulose, sodium or calcium phosphates, citric acid, glycine, polyethylene glycols (PEGs), and combinations thereof. In order to augment an immune response in a subject, the compositions provided herein further preferably include adjuvants, such as pharmacological agents, cytokines, or the like. Suitable adjuvants include any substance that enhances the immune response of the subject to the immunogenic polypeptides of the disclosure. Non-limiting examples of adjuvants include cytokines, e.g., IL-1, IL-2, IL-12, IL-6, and further include inorganic salts, e.g. aluminum hydroxide, aluminum phosphate, and calcium phosphate; oil emulsions, eg. mineral oil, MF59, QS-21, Montamide ISA51 and ISA-720; Isocoms, eg. ISCOMATRIX; microbial derivatives, eg. MPLA, macrophage-activating protein-2, virosomes, LT/CT, CpG; natural polymers, eg. polysaccharides; and synthetic polymers, eg. polyanhydrides and polyesters, as reviewed in Wilson-Welder et al. (Wilson-Welder J H, Torres M P, Kipper M J, Mallapragada S K, Wannemuehler M J, Narasimhan B. 2009. Vaccine Adjuvants: Current Challenges and Future Approaches. J Pharm Sci-Us 98:1278-1316). Adjuvants may be administered, for example, as proteins or other macromolecules at the same time, prior to, or subsequent to, administration of the attenuated cells.

The present disclosure still further provides a screening method for identifying a candidate compound for use in the treatment of patients with a infected by a pathogenic bacterial species, the method comprising:

(a) providing a test compound;

(b) comparing in a functional assay the effect of the test compound with a control on the native function of a SLAM polypeptide in the pathogenic bacterial species; and (c) identifying a test compound exhibiting an effect on the native function of a SLAM polypeptide.

In preferred embodiments, the pathogenic bacterial species belongs to the genus *Neisseria.*

In accordance with the foregoing a chemical compound may be evaluated for its utility to treat patients with a *Neisseria* infection. Typically this is achieved by providing one or a more compounds that one wishes to test and the performance of a functional assay. The assay is preferably an in-vitro assay, and can be configured so that multiple compounds can be evaluated simultaneously. The functional assay can be any assay that is capable of detecting an effect on the native function of a SLAM polypeptide. For example, the assay can involve evaluation of the transport of a target protein to the cellular surface in the presence of the chemical compound, notably comparison of transport in the presence of a negative control (e.g. an innocuous compound) or a positive control (i.e. a compound known to having an effect on function of SLAM proteins). Thus for example, TbpB transport can be monitored upon selecting a chemical compound exhibiting an effect on the native function of a SLAM polypeptide, further evaluation of the selected compound may include testing of the compound in in vitro or in vivo tests, including administration of the chemical compound to a human.

Hereinafter are provided examples of specific embodiments for performing the methods of the present disclosure, as well as embodiments representing the compositions of the present disclosure. The examples are provided for illustrative purposes only, and are not intended to limit the scope of the present disclosure in any way.

EXAMPLES

Example 1

Isolation of a Polynucleotide Encoding a SLAM Polypeptide (SLAM 1)

In vitro transposition of N.men-B16B6 genomic DNA was performed using a EZ::TN<KAN2> Transposon kit (Epicentre). Approximately 400 ng of sonicated DNA (1-6 kb) was mixed with 10 μl of transposase in a 100 μl reaction and incubated at 37° C. for 2 hours. EZTNS-Stop solution was added and incubated at 70° C. for 10 minutes. After concentration by ethanol precipitation, the DNA was repaired with T4 DNA polymerase and T4 ligase (V. pelicic, S. Morelle, D. Lampe, X. Nassif, Journal of Bacteriology, 182: 5391 (Oct. 1, 2000)).

The transposon was introduced to B16B6 by spot transformation (T. H. Dillard et al. Surg. Obes. Rel. Dis. 9: 269 (Jan. 1, 2013)). Briefly, the reaction mix was spotted on a Brain Heart Infusion (BHI) plate where N.men-B16B6 colonies were used to streak the entire plate including the spots.

The plate was incubated at 37° C. with 5% $CO_2$ for 8 hours or until colonies appeared. The meningococci grown on the spots were plated on BHI plates containing kanamycin (80 μg/mL) and incubated overnight. Transposon mutants were collected into microtiter plates and grown in liquid BHI for 6 hours before freezing at −80° C. in BHI with 20% glycerol.

Transposon mutants were screened for the presence of surface TbpB by dot blot. Whole cells were fixed with 2% formaldehyde in PBS, spotted on nitrocellulose, blocked with 5% skim milk, and incubated with rabbit anti-TbpB antibodies. Mutants that did not show surface TbpB were sequenced by RATE PCR (T. F. Ducey, Dyer D., Epicentre Forum 9, (2002)) or splinkerette PCR (C. J. Potter, L. Luo, PLoS ONE 5, e10168 (Jan. 1, 2010)). For RATE PCR, genomic DNA was mixed with a single primer (inv1 or inv2) for a three step PCR reaction consisting of stringent annealing temperatures in the first round, low annealing temperatures in the second, and stringent annealing temperatures in the third. The resulting product was sequenced with Kan F or Kan R primers. For splinkerette PCR, genomic DNA is digested by restriction enzymes (BstY1, BglII, or HindIII) separately, producing sticky ends that could be ligated to the spinkerette oligonucleotide. The resulting product is used for two nested PCRs to amplify the genomic sequence between the TN5 insertion and the splinkerette. The product is used for sequencing with another nested primer. Using the foregoing approach the polynucleotide encoding SLAM 1 set for the in SEQ ID NO: 385 was obtained.

Restriction free cloning was employed for the following plasmid construct (F van den Ent, J. Lowe, Journal of Biochemical and Biophysical Methods (Jan. 1, 2006)). Briefly, to replace the NMB0313 ORF with a kanamycin cassette, an ~2500 bp fragment containing NMB0313 and 500 bp upstream and downstream of NMB0313 was cloned into pUC19 using F1 (pUC19OmpU476RF) and R1 (pUC19-OmpURev). KAN2 from the EZ::TN transposon kit was amplified using primers F2 (F-RF-OmpUdKan) and R2 (R-RF-OmpUdKan) and the resulting megaprimer was used to replace the NMB0313 ORF in a secondary RF reaction. The resulting plasmid was used for spot transformation in WT B16B6. Knockouts were selected on BHI plates containing kanamycin (80 μg/mL) and verified by PCR using primers that flank NMB0313.

Complementation vector pSLAM was constructed by cloning the NMB0313 gene into the PacI/FseI site of pGCC4 (I. J. Mehr, C. D. Long, C. D. Serkin, H. S. Siefert, Genetics, 154, 523 (Feb. 1, 2000)) (Gift from H. Siefert) using primers F3 (F-RF-pGOmpU) and R3 (R-RF-pGOmpU). A HIS tag was inserted after the signal peptide by amplifying the whole vector with phosporylated primers F4 (F-OmpU-HIS phos) and R4 (R-OmpU-HIS phos) that contain the HIS tag, and ligating the products. Knockouts and transposon mutants were complemented with pSLAM by spot transformation and selection on erythromycin (30 μg/mL) plates. Insertion of NMB0313 was verified by PCR. Expression was induced by growing colonies on 1 mM IPTG BHI plates and verified by anti-HIS westerns.

Example 2

Purification of a First SLAM Polypeptide (SLAM 1)

Figure 2:
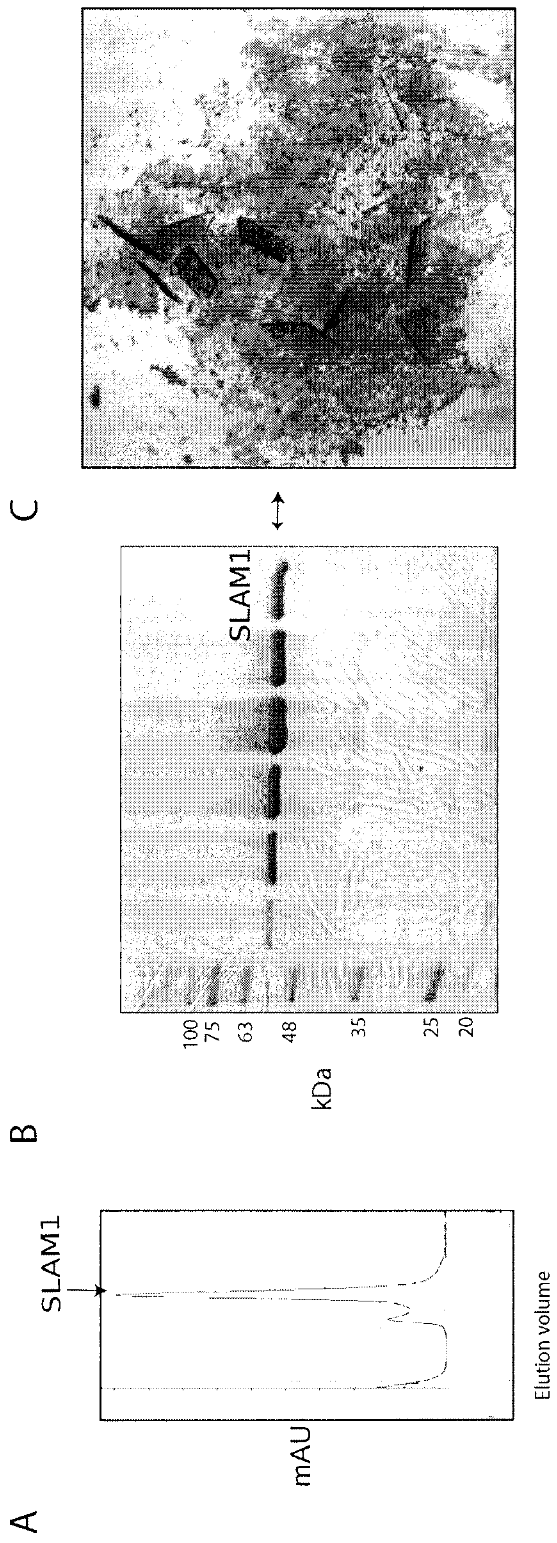
FIG. 2 shows an overview of the various stages of SLAM1 purification and crystallization.

SLAM polypeptides were purified as outlined in FIG. 1. NMB0313 and its homologs were cloned into pET26, and expressed with an N-terminal pelB signal peptide followed by a non-cleavable 7× His tag. The plasmid was transformed into *E. coli* BL21-C43 cells and grown in Luria-Broth (LB) at 37° C. with 50 μg/mL Kanamycin to an $OD_{600}$ of 0.8, at which point protein expression was induced with the addition of isopropyl β-D-1-thiogalactopyranoside (IPTG) to a final concentration of 1 mM. Cells were grown for an additional 18 hours at 37° C. and were harvested by centrifugation at 4000×g. The cells were washed and resuspended in 100 mL of lysis buffer (50 mM potassium phosphate, pH 7.5 and 0.2 mM PMSF) per 5 g of cells. Cell lysis was carried out by sonication on ice, with four 30 second pulses in the presence of lysozyme and DNase. Unlysed cells were removed by centrifugation at 10,000×g for 20 minutes. The lysate was then centrifuged at 95,834×g for 1 hour to isolate the membrane fraction. The pellet was washed and resuspended in 50 mL of extraction buffer (50 mM potassium phosphate, pH 7.5 and 3% Elugent (Millipore)) per 5 g of cells lysed. The extraction was carried out overnight at 4° C. After a 40 minute centrifugation at 95,834×g, the solubilized protein was passed through a 0.45□m filter and was loaded onto a 1 mL Ni-NTA resin column (GE) equilibrated with Buffer A (50 mM potassium phosphate, 0.6% $C_8E_4$ (Affymetrix)). Imidazole gradients were made by mixing buffer A with buffer B (50 mM potassium phosphate, 0.6% $C_8E_4$, 400 mM imidazole). The column was washed with 20 mM, 60 mM, and 80 mM imidazole and desired protein was eluted in 260 mM imidazole. Purity was verified by SDS-PAGE and further purification was achieved by size exclusion chromatography with a 24 mL Superdex-200 (GE) equilibrated in 20 mM HEPES, pH 8, 150 mM NaCl, 0.6% $C_8E_4$. A single peak containing 5H3 NMB0313 was collected from the Sephadex-200 and was concentrated at 6 mg/mL using a 50 kDa concentrator (Millipore). Results are shown in FIG. 2.

Example 3

Identification of Other Polynucleotides Encoding SLAM Polypeptides, Including SLAM 2

Figure 3:
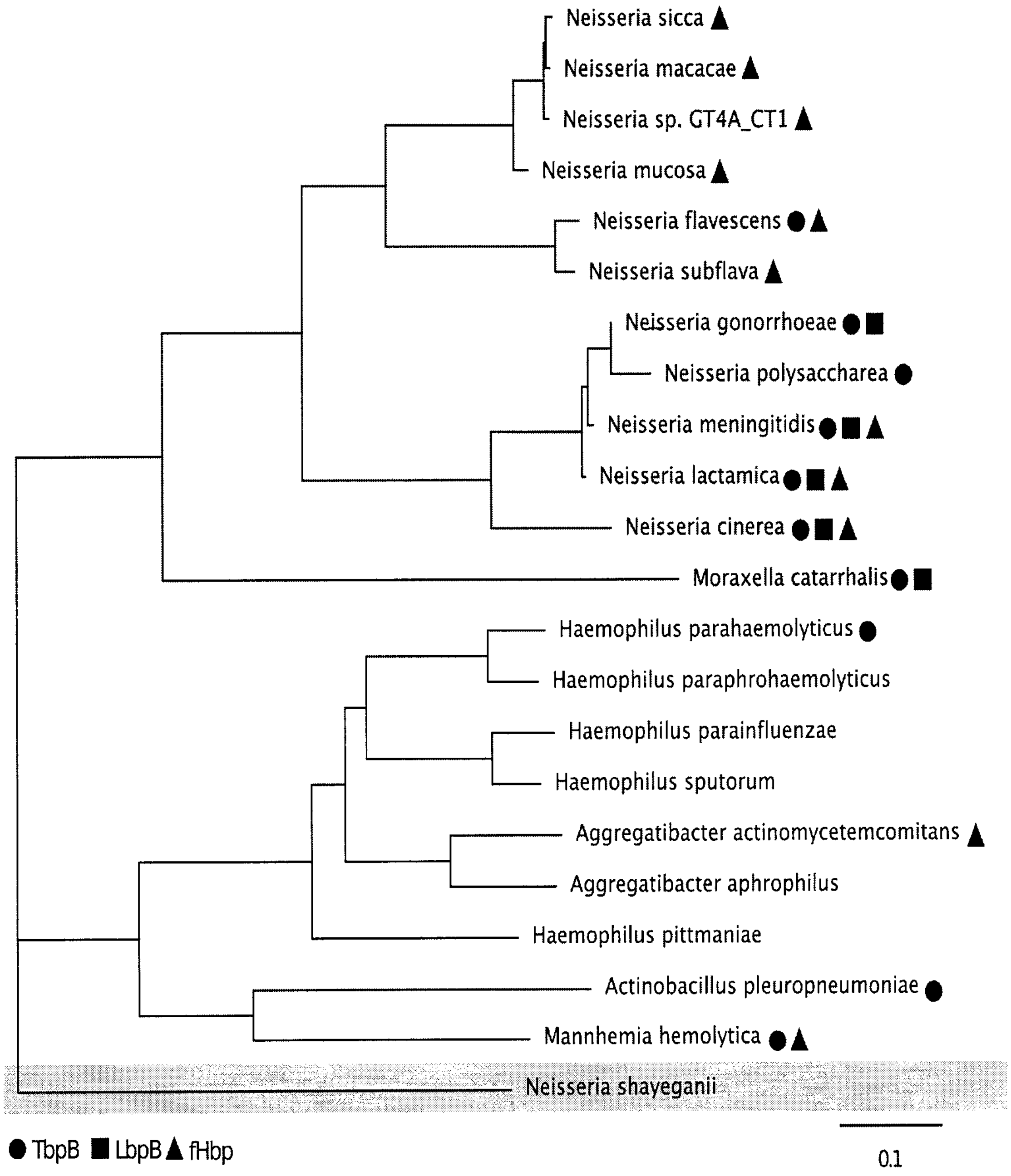
FIG. 3 shows a phylogenetic tree and the phylogenetic relationships of various SLAM polypeptide homologs in various bacterial species. The SLAM homologs in Group 1 (light box, top) belong to the *Neisseria* genus and *Moraxella catarrhalis*, while Group 2 (medium gray, middle) contains different members from the Pasteurellaceae family of Gamma-proteobacteria. Group 3 (dark green, bottom) contains only *Neisseria shayeganii.*

A_Blastp search was conducted using the SLAM1 protein sequence (SEQ ID NO: 385) as a template. The results were then filtered to remove SLAM hits from multiple strains of the same organism, and the top hit was kept. The multiple sequence alignments and phylogenetic tree (neighbor-joining) construction was done using Geneious R7 (Biomatters, http://www.geneious.com/). The tree was re-sampled 100 times using the in-built bootstrap module. fHBP, TbpB and LbpB homologs were searched in each of the genomes that contain a SLAM hit, and added to the phylogenetic tree. The phylogenetic tree is shown in FIG. 3. Referring to FIG. 3, SLAM homologs (identified by BLAST searches of bacterial genomes) cluster into three groups. The SLAM homologs in Groups 1 (light gray, top) belong to the *Neisseria* genus and *Moraxella catarrhalis*, while Group 2 (medium gray, middle) contains different members from the Pasteurellaceae family of Gamma-proteobacteria. Group 3 (dark gray, bottom) contains only *Neisseria shayeganii*. The tree has been abbreviated for clarity; multiple hits from a single species were not included, and bootstrap values were removed. Species that possess a TbpB, LbpB, or fHbp homolog in their genome are indicated by circle, square and triangle respectively. The polynucleotide sequence of a second SLAM polypeptide of *Neisseria meningitides*, SLAM 2, is set forth herein as SEQ ID NO: 387.

Example 4

Purification of a Second SLAM Polypeptide (SLAM2)

Figure 4:
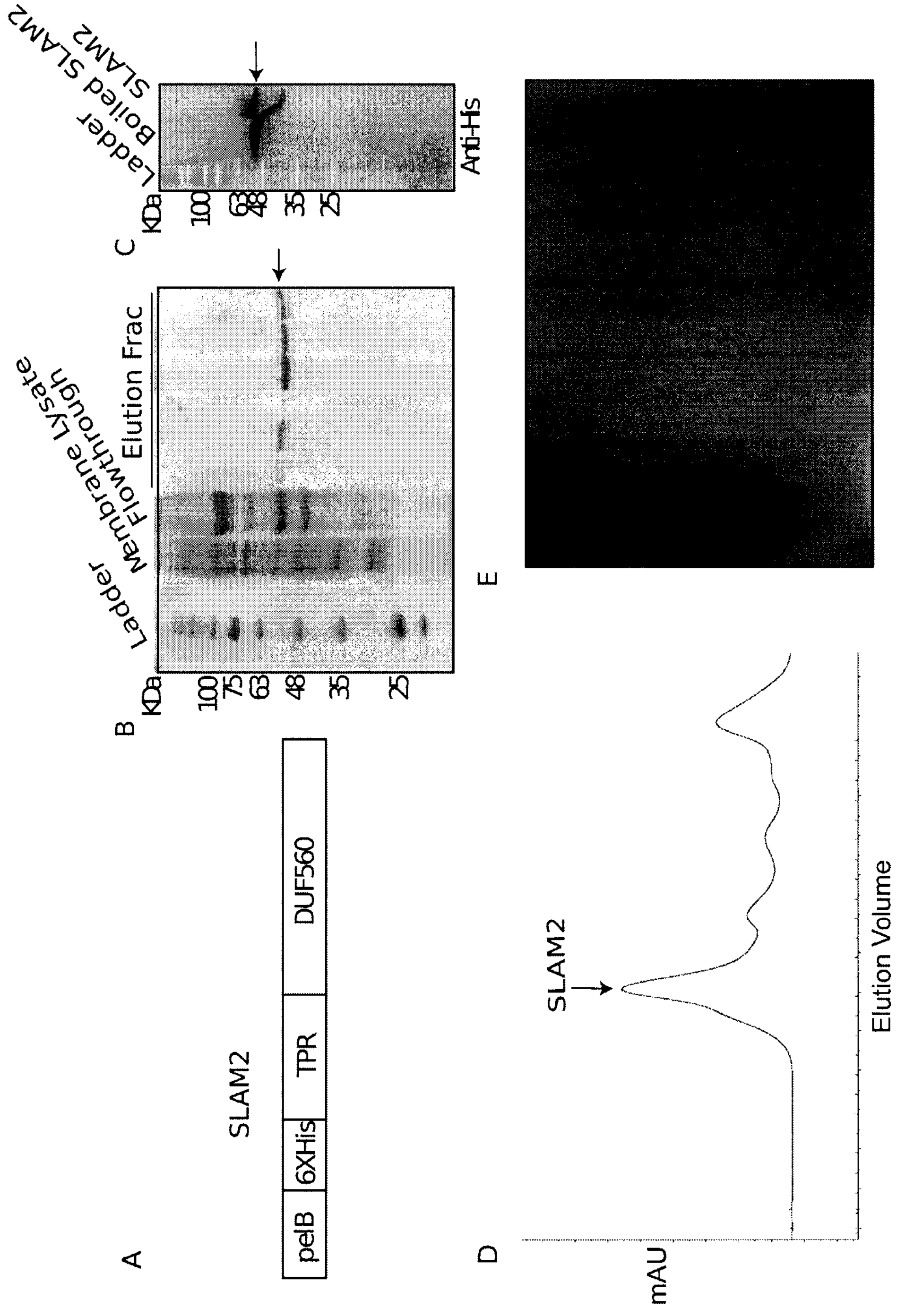
FIG. 4 shows an overview of the various stages of SLAM2 purification and crystallization.

A second SLAM polypeptide of *Neisseria meningitides* (SLAM 2; SEQ ID NO: 387) was purified using the methodology as further described in Example 2. FIG. 4 shows the results obtained.

Example 5

Surface Lipoprotein Translocation Using an Intact and Truncated SLAM 1 Polypeptide

Figure 5:
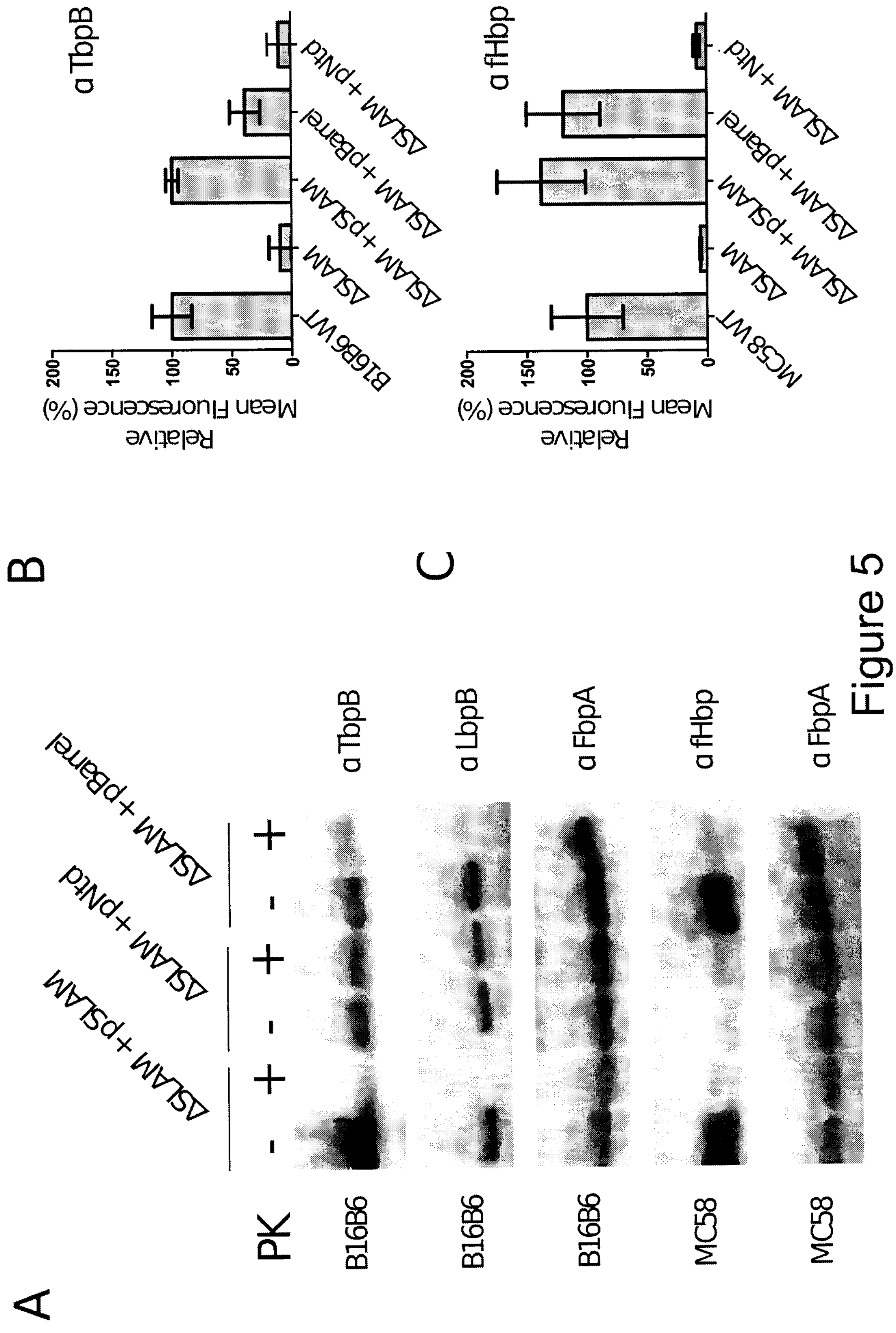
FIG. 5 shows N-terminal and C-terminal portions of the SLAM 1 polypeptide (FIG. 5A), and results obtained in the evaluation of translocation of surface lipoproteins using a *Neisseria meningitidis* knock-out strain transformed with SLAM1 and portions thereof and flow cytometry (FIG. 5B) and proteinase K digestion results (FIG. 5C).

*Neisseria meningitidis* SLAM knockout strain Δmnb0313 was used to evaluate translocation of surface lipoproteins (SLPs). Full-length SLAM polypeptides and N-terminal and C-terminal portions of the SLAM polypeptide were used. The N-terminal and C-terminal portions are shown in FIG. 5 A. Flow cytometry (FIG. 5B) and proteinase K digestion (FIG. 5C) experiments reveal that the SLP translocation defect observed in the SLAM knockout strain can be rescued with only the C-terminal 8-barrel domain (amino acids 204-488). The N-terminal domain (Ntd) (amino acids 32-203) of SLAM does not provide any SLP translocation activity. The mean fluorescent intensity was measured for each sample and the signal obtained from wildtype cells was set to 100% for comparison with signals from knockout and single domain complemented cells. Error bars represent the standard error of the mean (SEM) from three experiments. A * indicates results are significantly different at $p<0.05$.

Example 6

Co-Expression of SLAM and Surface Lipoproteins, TbpB, LbpB and fHbp in *E. coli*

TbpB and NMB0313 genes were amplified from the genome of *Neisseria meningitidis* serotype B strain B16B6. The LbpB gene was amplified from *Neisseria meningitidis* serotype B strain MC58. Full length TbpB was inserted into Multiple Cloning Site 2 of pETDuet using restriction free cloning ((F van den Ent, J. Lowe, Journal of Biochemical and Biophysical Methods (Jan. 1, 2006)).). NMB0313 was inserted into pET26, where the native signal peptide was replaced by that of pelB. Mutations and truncations were performed on these vectors using site directed mutagenesis and restriction free cloning, respectively. Pairs of vectors were transformed into *E. coli* C43 and were grown overnight in LB agar plates supplemented with kanamycin (50 ng/mL) and ampicillin (100 ng/mL).

tbpB genes were amplified from the genomes of *M. catarrhalis* strain O35E and *H. influenzae* strain 86-028NP and cloned into the pET52b plasmid by restriction free cloning as above. The corresponding SLAMs (*M. catarrhalis* SLAM 1, *H. influenzae SLAM*1) were inserted into pET26b also using restriction free cloning. A 6His-tag was inserted between the pelB and the mature SLAM sequences as above. Vectors were transformed into *E. coli* C43 as above.

Figure 6:
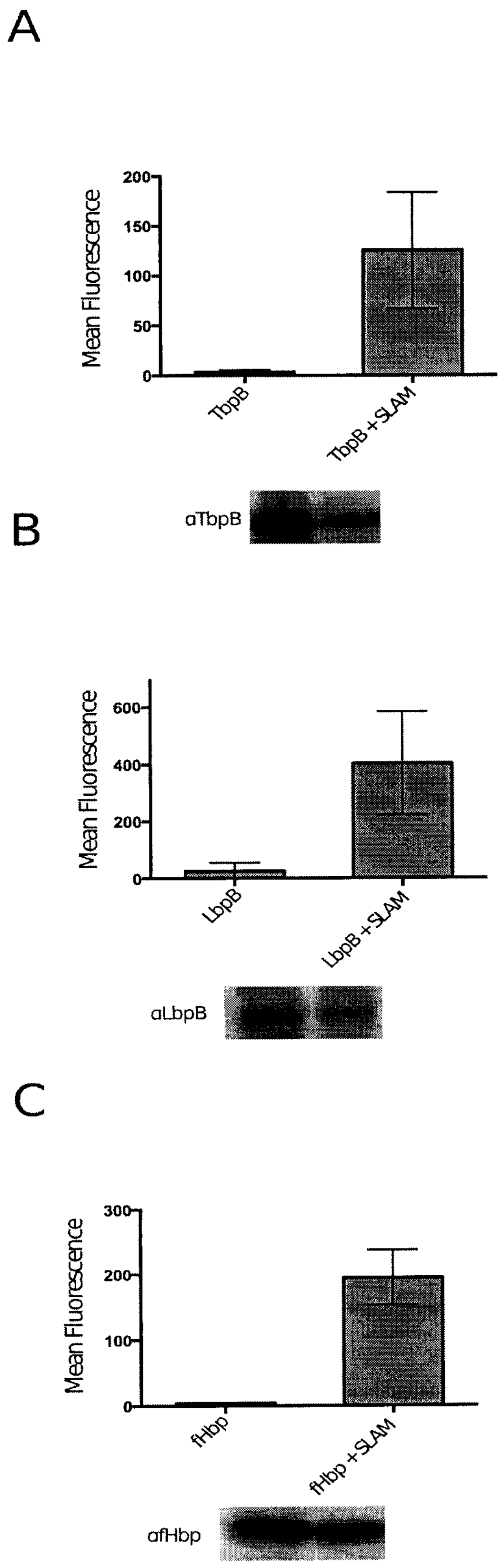
FIG. 6 shows results obtained following expression of SLAM 1 in *E. coli* in conjunction with SLPs. Shown are quantitative fluorescence (histograms) and Western blots showing translocation. Shown are results obtained using TbpB (FIG. 6A), LbpB (FIG. 6B) and fHbp (FIG. 6C). Histograms display the mean fluorescent intensity measured for each sample after incubation with either human transferrin or SLP specific antibody followed by incubation with a secondary fluorescent molecule.
Figure 10:
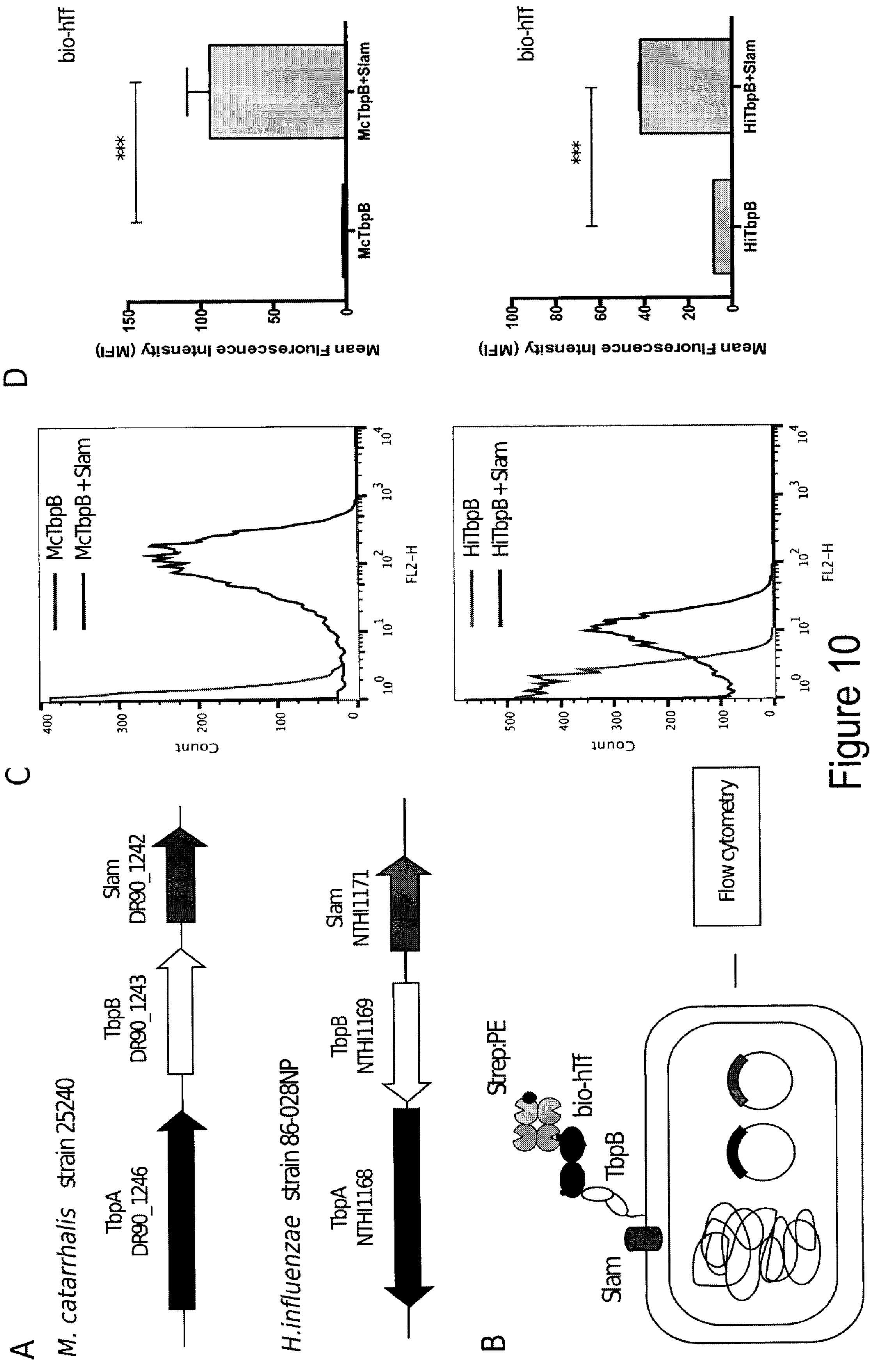
FIG. 10 shows the translocation of SLAM and TbpB pairs from *Moraxella catarrhalis* and *Haemophilus influenzae* in *Escherichia coli*.

Cells were harvested by centrifugation at 4000 g and were twice washed with 1 mL PBS to remove any remaining growth media. Cells were then incubated with either 0.05-0.1 mg/mL biotinylated human transferrin (Sigma-aldrich T3915-5MG), α-TbpB (1:200 dilution from rabbit serum for *M. catarrhalis* and *H. influenzae;* 1:10000 dilution from rabbit serum for *N. meningitidis*), or α-LbpB (1:10000 dilution from rabbit serum-obtained a gift from J. Lemieux) or α-fHbp (1:5000 dilution from mouse, a gift from D. Granoff) for 1.5 hours at 4° C., followed by two washes with 1 mL of PBS. The cells were then incubated with R-Phycoerythrin-conjugated Streptavidin (0.5 mg/ml Cedarlane) or R-phycoerythrin conjugated Anti-rabbit IgG (Stock 0.5 mg/ml Rockland) at 25 ug/mL for 1.5 hours at 4° C. The cells were then washed with 1 mL PBS and resuspended in 200 uL fixing solution (PBS+2% formaldehyde) and left for 20 minutes. Finally, cells were washed with 2×1 mL PBS and transferred to 5 mL polystyrene FACS tubes. The PE fluorescence of each sample was measured for PE fluorescence using a Becton Dickinson FACSCalibur. The results were analyzed using FLOWJO software and were presented as mean fluorescence intensity (MFI) for each sample. For *N. meningtidis* experiments, all samples were compared to wildtype strains by normalizing wildtype fluorescent signals to 100%. Errors bars represent the standard error of the mean (SEM) across three experiments. Results were plotted statistically analysed using GraphPad Prism 5 software. The results shown in FIG. 6 for the SLPs, TbpB (FIG. 6A), LbpB. (FIG. 6B) and fHbp (FIG. 6C) demonstrate that SLAM effects translocation of all three SLP polypeptides in *E. coli*. The results shown in FIG. 10 demonstrate that translocation of TbpB from *M. catarrhalis* (FIG. 10C) and in *H. influenzae* (FIG. 10D) in *E. coli* require the co-expression of the required SLAM protein (Slam is an outer membrane protein that is required for the surface display of lipidated virulence factors in *Neisseria*. Hooda Y, Lai C C, Judd A, Buckwalter C M, Shin H E, Gray-Owen S D, Moraes T F. Nat Microbiol. 2016 Feb. 29; 1:16009).

Example 7

Reduction of Virulence of a *Neisseria* Strain Comprising an Impaired SLAM Gene

Sepsis modeling was performed as described by Gorringe A. R., Reddin, K. M., Voet P. and Poolman J. T. (Methods Mol. Med. 66, 241 (Jan. 1, 2001)) and Johswich, K. O. et al. (Infect. Immun. 80, 2346 (Jul. 1, 2012)). Groups of 6 eight-week-old C57BL/6 mice (Charles River Laboratories) were inoculated via intraperitoneal injection with *N. meningitidis* strain B16B6, B16B6 Δtbpb, or B16B6 Δnmb0313 (N=2 independent experiments). To prepare inoculums, bacterial strains for infection were grown overnight on GC agar, resuspended and then grown for 4 h in 10 ml of Brain Heart Infusion (BHI) medium at 37° C. with shaking. Cultures were adjusted such that each final 500 μl inoculum contained $1\times10^6$ colony forming units and 10 mg human holo-transferrin. Mice were monitored at least every 12 h starting 48 h before infection to 48 h after infection for changes in weight, clinical symptoms and bacteremia. Mice were scored on a scale of 0-2 based on the severity of the following clinical symptoms: grooming, posture, appearance of eyes and nose, breathing, dehydration, diarrhea, unprovoked behavior, and provoked behavior. Animals reaching endpoint criteria were humanely euthanized. Animal experiments were conducted in accordance with the Animal Ethics Review Committee of the University of Toronto.

Figure 7:
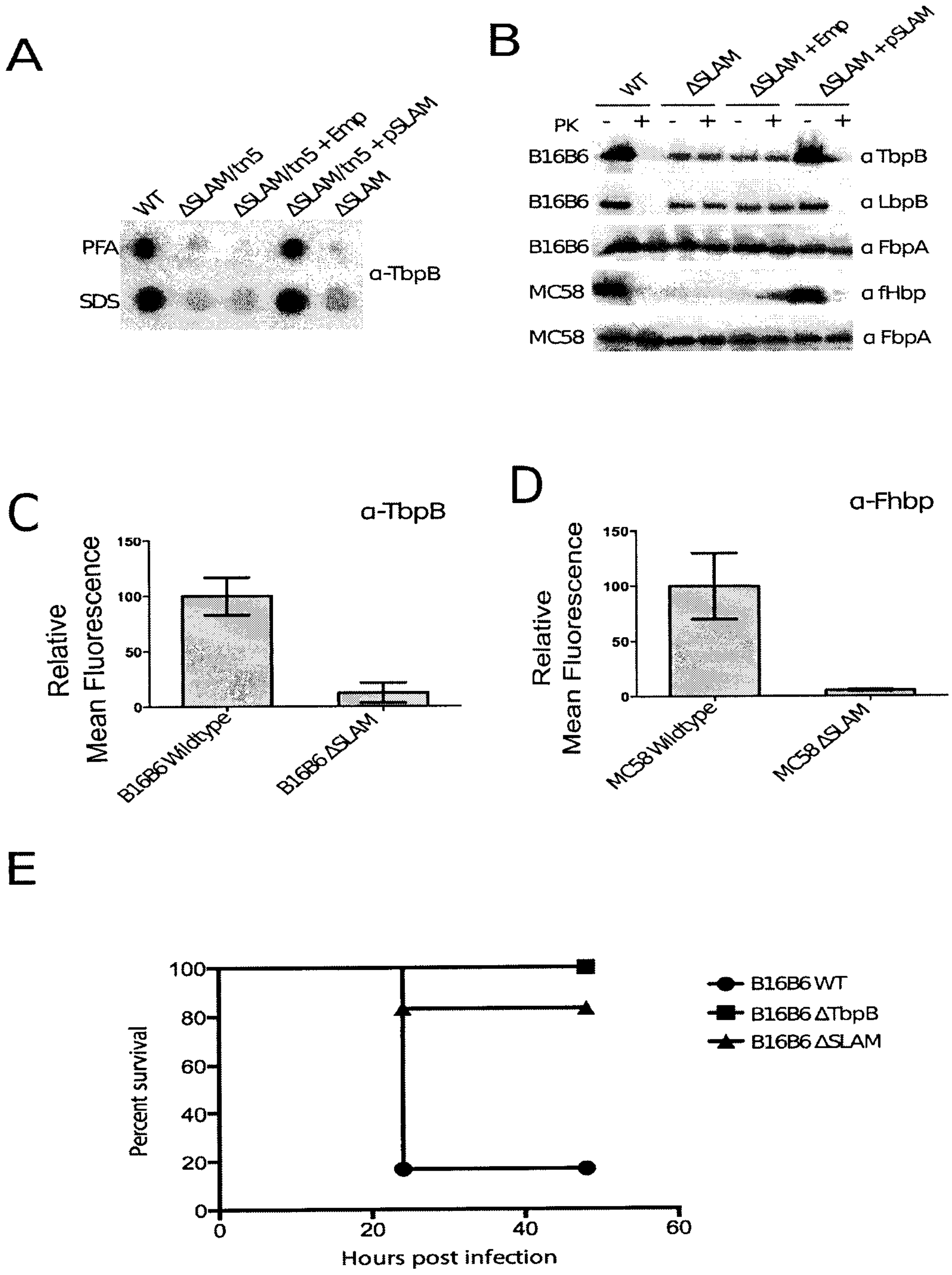
FIG. 7 shows results obtained in the evaluation of SLAM impaired *Neisseria* strains.

FIG. 7 shows the results obtained. FIG. 7A shows a solid phase binding assay consisting of N.men cells fixed with paraformaldehyde (PFA) or lysed with SDS and were spotted onto nitrocellulose and probed with α-TbpB antibodies. ΔSLAM/tn5 refers to the original strain of SLAM deficient cells obtained through transposon insertion. SLAM describes the knockout of SLAM in *Neisseria meningitidis* obtained by replacing the SLAM ORF with a kanamycin resistance cassette. FIG. 7B shows a Proteinase K digestion assay showing the degradation of TbpB, LbpB and fHbp only when Nm cells are SLAM deficient (ΔSLAM). Nm cells expressing individual SLPs alone and with SLAM were incubated with proteinase K and Western blots were used to detect levels of all three SLPs levels with and without protease digestion (−/+). Flow cytometry was used to confirm that SLAM cells could not display TbpB (FIG. 7C) or fHbp (FIG. 7D) on the cell surface. Antibodies against TbpB and fHbp were used to bind surface exposed SLPs followed by incubation with a α-Rabbit antibody linked to phycoerythrin to provide fluorescence. The mean fluorescent intensity (MFI) of each sample was measured using the FL2 detector of a BD FACS Calibur. The signal obtained from wildtype cells was set to 100% for comparison with signals from knockout cells. Error bars represent the standard error of the mean (SEM) from three experiments. Shown in FIG. 7E are the results of mice infections with various strains. Mice were infected via intraperitoneal injection with $1\times10^6$ CFU of wildtype *N. meningitidis* strain B16B6, B16B6 with a knockout of TbpB (ΔtbpB), or B16B6 with a knockout of nmb0313 Δslam and monitored for survival and disease symptoms every 12 h starting 48 hr pre-infection to 48 h post-infection and additionally monitored at 3 hr post-infection. Statistical differences in survival were assessed by a Mantel-Cox log rank test (GraphPad Prism 5) (*$p<0.05$, n.s. not significant). These results show a marked reduction in post-infection mortality in mice infected with the knockout of nmb0313 Δslam strain.

Example 8

Identification of Novel SLAM-Dependent Surface Lipoproteins in *Pasteurella multocida*

In selecting genomes for a given bacterial species where a SLAM homolog was identified, preference was given to reference genomes that contained fully sequenced genomes. SLAM homologs were identified using iterative Blast searches into closely related species to *Neisseria* to more distantly related species. For each of the SLAM homologs identified in these species, the corresponding genomic record (NCBI genome) was used to identify genes upstream and downstream along with their corresponding functional annotations (NCBI protein database, Ensembl bacteria). In a few cases, no genes were predicted upstream or downstream of the SLAM gene as they were too close to the beginning or end of the contig, respectively, and thus these sequences were ignored.

Neighbouring genes were analyzed for 1) an N-terminal lipobox motif (predicted using LipoP, SignalP), and 2) a solute binding protein, Tbp-like (InterPro signature: IPR or IPR011250), or pagP-beta barrel (InterPro signature: IPR011250) fold. If they contained these elements, we identified the adjacent genes as potential SLAM-dependent surface lipoproteins.

A putative SLAM (PM1515, SEQ ID NO: 1087) was identified in *Pasteurella multocida* using the *Neisseria* SLAM as a search. The putative SLAM (PM1515, SEQ ID NO: 1087) was adjacent to a newly predicted lipoprotein gene with unknown function (PM1514, SEQ ID NO: 1083) (FIG. 11A). The putative SLAM displayed 32% identity to *N. meningitidis* SLAM1 while the SLP showed no sequence similarity to known SLAM-dependent neisserial SLPs.

The putative SLAM (PM1515, SEQ ID NO: 1087) and its adjacent lipoprotein (PM1514, SEQ ID NO: 1083) were cloned into pET26b and pET52b, respectively, as previously described and transformed into *E. coli* C43 and grown overnight on LB agar supplemented with kanamycin (50 ug/ml) and ampicillin (100 ug/ml).

Cells were grown in auto-induction media for 18 hours at 37 C and then harvested, washed twice in PBS containing 1 mM MgCl2, and labeled with α-Flag (1:200, Sigma) for 1 hr at 4 C. The cells were then washed twice with PBS containing 1 mM MgCl2 and then labeled with R-PE conjugated α-mouse IgG (25 ug/mL, Thermo Fisher Scientific) for 1 hr at 4 C. following straining, cells were fixed in 2% formaldehyde for 20 minutes and further washed with PBS containing 1 mM MgCl2. Flow Cytometry was performed with a Becton Dickinson FACSCalibur and the results were analyzed using FLOWJO software. Mean fluorescence intensity (MFI) was calculated using at least three replicates was used to compare surface exposure the lipoprotein in strains either containing or lacking the putative SLAM (PM1515) and are shown in FIG. 11C and FIG. 11D. PM1514 could be detected on the surface of *E. coli* illustrating i) that SLAM can be used to identify SLPs and ii) that SLAM is required to translocate these SLPs to the surface of the cell—thus identifying a class of proteins call "SLAM-dependent surface lipoproteins". Antibodies were raised against purified PmSLP (PM1514) and the protein was shown to be on the surface of *Pasteurella multocida* via PK shaving assays.

Example 9

Identification of the Translocation Motif of SLAM-Dependent Surface Lipoproteins and the Role in SLAM Specificity Minimal domain and domain swap constructs used were pETDUET HpuA (SEQ ID NO: 1099), TbpB N-lobe (SEQ ID NO: 1095), TbpB C-lobe (SEQ ID NO: 1097), and TbpB N-lobe-HpuA (SEQ ID NO: 1101). The mature HpuA was amplified and inserted in frame with the signal peptide of TbpB and simultaneously replaced the rest of the TbpB gene in pETDUET TbpB to create pETDUET HpuA using restriction free cloning. The anchor peptide (amino acids 1-40), N-lobe of TbpB (amino acids 41-331) and the C-lobe of TbpB (amino acids 332-579) were parsed based on the *N. meningitidis* strain B16B6 TbpB structure (PDB ID 4QQ1). The N-lobe construct was cloned using inverse cloning to insert a stop codon between the N and C lobes of TbpB using pETDUET TbpB as template. The C-lobe construct of TbpB was cloned using restriction free cloning to insert and simultaneously replace the TbpB N-lobe in pETDUET TbpB N-lobe. The C-lobe was inserted in frame with the anchor peptide. The fusion construct pETDUET TbpB N-lobe-HpuA was cloned by inserting HpuA (amino acids 2-end) in frame with the N-lobe of pETDUET TbpB N-lobe by restriction free cloning. Poly-Ala mutations were created with FastCloning using pETDUET TbpB as template. Vectors containing either SLAM1 or SLAM2 were used.

Figure 12:
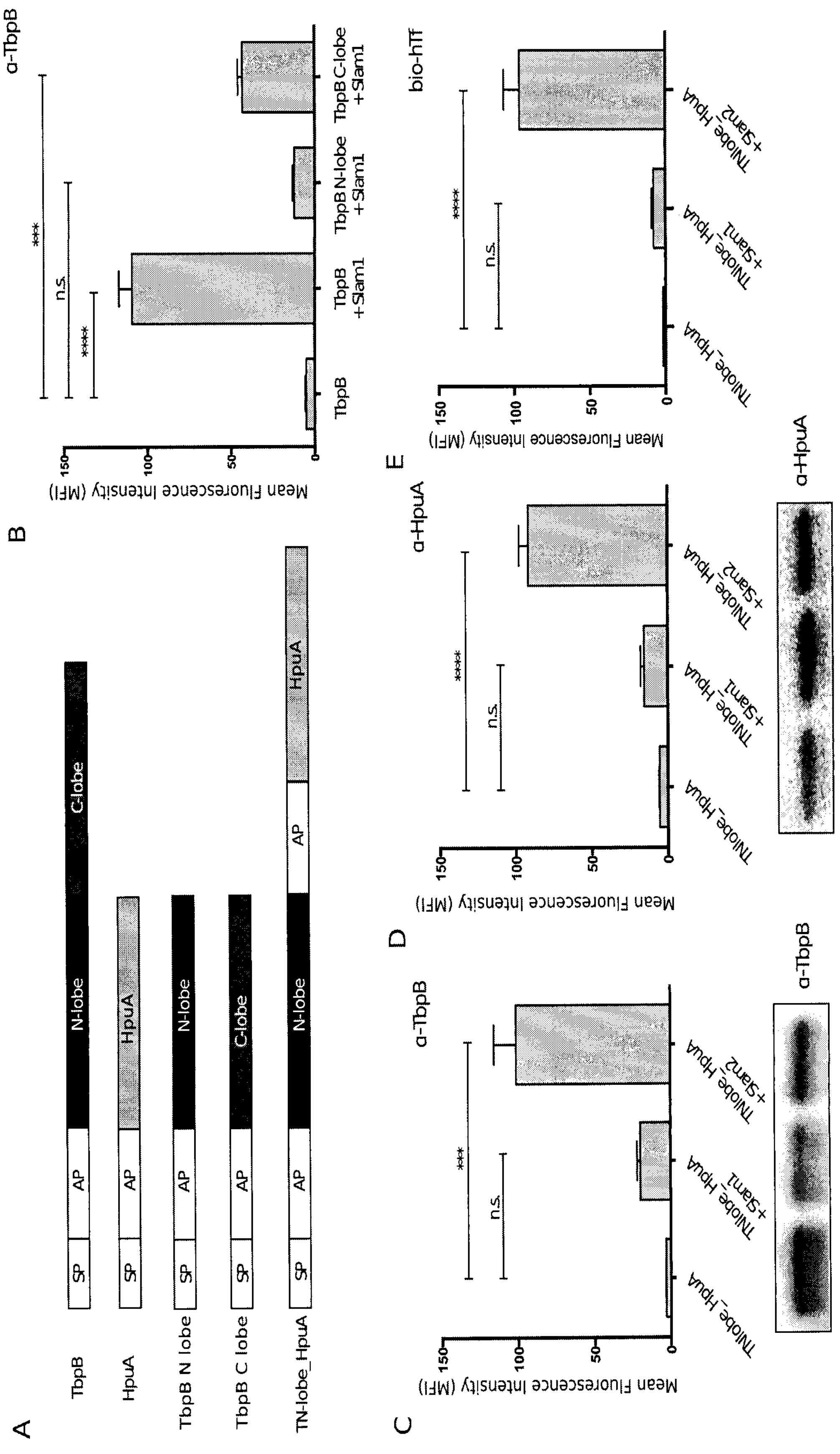
FIG. 12 shows the identification of where a translocation motif lies on TbpB.

Plasmids were transformed into *E. coli* C43 (DE3) cells and grown in auto-induction media for 18 hours at 37 C. Cells were harvested, washed twice in PBS containing 1 mM MgCl2, and labeled with either α-TbpB antibodies (1:200, rabbit sera) or biotinylated human transferrin (0.05 mg/ml, Sigma) for 1 hr at 4 C. The cells were then washed twice with PBS containing 1 mM MgCl2 and then labeled with R-FITC conjugated α-rabbit IgG (25 ug/ml, Thermo Fisher Scientific) for 1 hr at 4 C. Following staining, cells were fixed in 2% formaldehyde for 20 minutes and further washed with PBS containing 1 mM MgCl2. Flow Cytometry was performed with a Becton Dickinson FACSCalibur and the results were analyzed using FLOWJO software. Mean fluorescence intensity was calculated using at least three replicates and was used to compare surface exposure of a given SLP between different strains. The C-lobe of TbpB appears to be required for SLAM1 dependent translocation to the surface of *E. coli* (FIG. 12B), while the N-lobe does not appear to play a significant role. Additionally, the use of HpuA fused to the TbpB N-lobe shifts SLAM dependency from SLAM1 to SLAM2 (FIG. 12C-E).

Using the above methodology, four of the eight beta-barrel strands were probed for importance in surface display of surface lipoproteins. Mutation of two of the beta-barrel strands of *N. meningitidis* TbpB, strands B30 (SEQ ID NO: 1107) and B31 (SEQ ID NO: 1109), were shown to be required for surface expression of TbpB (FIG. 13C and FIG. 13D).

Multiple sequence alignments were performed on the last two strands of the eight-stranded barrel domain of the C-lobe from TbpB from *N. meningitidis, N. gonorrhoeae, M. catarrhalis, H. influenzae*, and *A. pleuropneumoniae*, the C-lobe of LbpB from *N. meningitidis* and *N. lactamica*, and from HpuA from *N. meningitidis, N. gonorrhoeae*, and *K. denitrificans*. Strand B30 was shown to have a conserved [L/M]GGx[F/I/V] sequence and stand B31 appears to have a conserved ϕx[A/T/V]FG[A/G] sequence, as shown in FIG. 13E.

Example 10

Identification of a Novel SLAM-Dependent Surface Lipoprotein in *Actinobacter baumannii*

*A. baumannii* is an opportunistic pathogen, and causes disease in intensive care patients, and those who are immunocompromised or have underlying disease (Camp, C. & Tatum, O. L. Lab. Med. 41, 649-657 (2010)). *A. baumannii* causes a variety of clinical manifestations such as pneumonia, sepsis and urinary tract infections. It has gained notoriety for causing soft tissue infections in combat zone hospitals. Multi-drug resistant *A. baumannii* poses a significant challenge to treating physicians and a threat to human health since *A. baumannii* is resistant to many of the antibiotics used in the clinic (Camp, C. & Tatum, O. L. Lab. Med. 41, 649-657 (2010)).

A SLAM-like protein (AbSLAM) was identified in a gene cluster in *A. baumannii* using iterative blast search with NmSLAM as the original query sequence (FIG. 14A) (SEQ ID NO: 1177 and 1178). Although this gene cluster was initially discovered by Antunes et al. while searching for genes involved in iron acquisition, the SLAM gene was misannotated as a hypothetical protein (Antunes, L. C. S., Imperi, F., Towner, K. J. & Visca, P. *Res. Microbiol.* 162, 279-284 (2011)). Adjacent to the SLAM gene is a gene encoding a lipoprotein of unknown function (AbSLP). This prediction is supported by the presence of a lipobox motif (LVAC) at the N-terminus of the protein.

Figure 14:
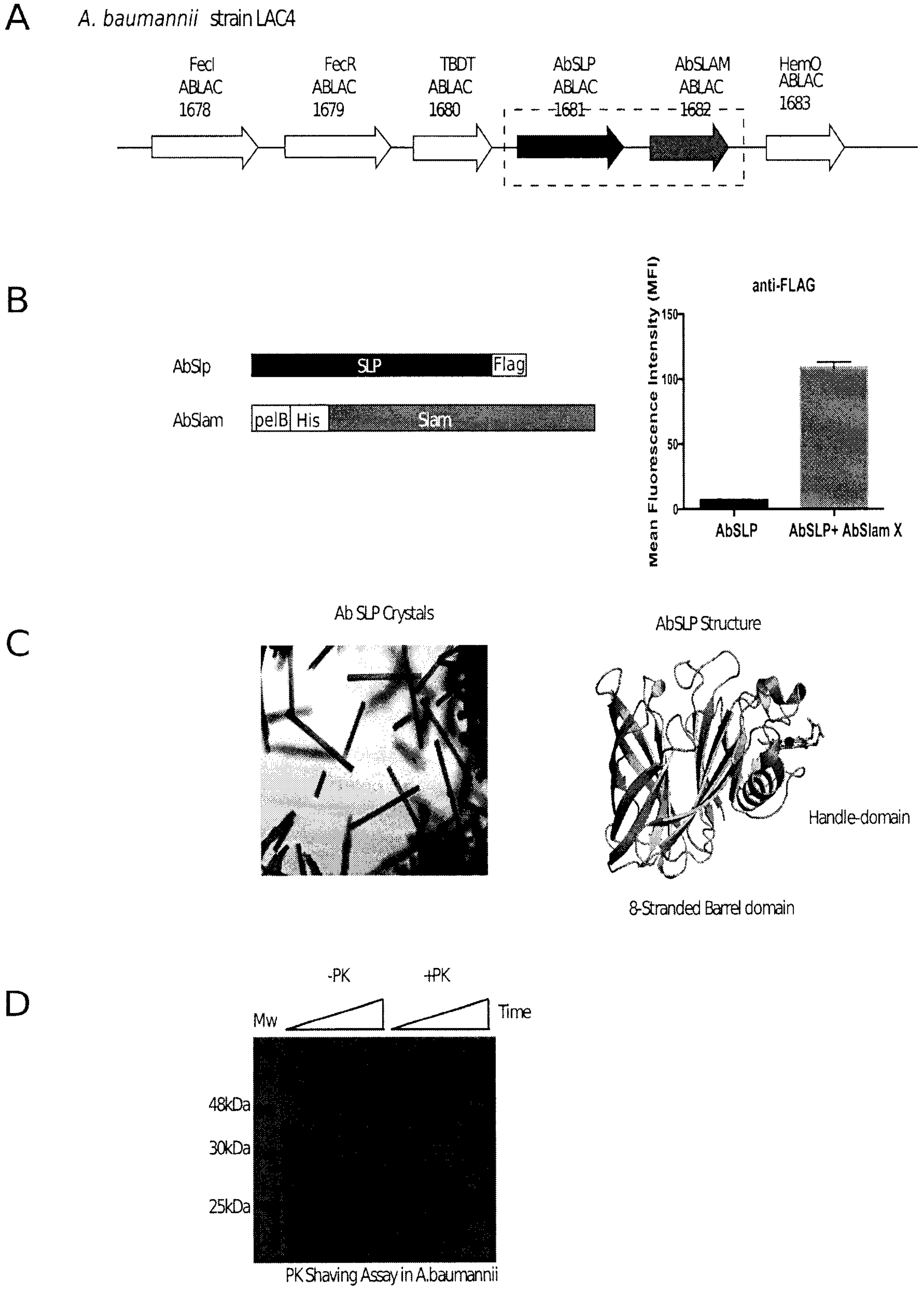
FIG. 14 shows the identification of a SLAM-dependent surface lipoprotein in *Actinobacter baumannii*.

We have demonstrated using flow cytometry that AbSLP can be exogenously expressed in *E. coli*, and localizes to the cell surface only when co-expressed with AbSLAM (FIG. 14B). Furthermore, the structure of AbSLP was solved by X-ray crystallography (FIG. 14C). AbSLP is comprised of an N-terminal β-handle consisting of 8 antiparallel β-strands and a C-terminal 8 stranded β-barrel. The structure shows that AbSLP is a heme binding protein with high structural similarity to the structures of known SLAM-dependent SLPs (TbpB, LbpB, HpuA). Expressing AbSLP with its SLAM leads to surface display of AbSLP in *E. coli* (FIG. 14B). Antibodies to AbSLP were raised and illustrate that AbSLP is located on the surface of *A. baumannii* (LAC4) by Proteinase K shaving (FIG. 14D).

The discovery of the novel SLP AbSLP by the presence of an adjacent SLAM gene illustrates the utility of SLAM to identify potential vaccine antigen SLPs that are located adjacent to the SLAM gene.

While the present disclosure has been described with reference to what are presently considered to be the preferred examples, it is to be understood that the disclosure is not limited to the disclosed examples. To the contrary, the disclosure is intended to cover various modifications and equivalent arrangements included within the spirit and scope of the appended claims.

All publications, patents and patent applications are herein incorporated by reference in their entirety to the same extent as if each individual publication, patent or patent application was specifically and individually indicated to be incorporated by reference in its entirety.

SEQUENCE LISTING (1184 sequences)

SEQ ID NO: 1 - DNA, 1443 bp, A. actinomycetemcomitans
atgaaacttaaccattcttttttcttttttgctttgtcgcttgcagcaacaagtatggtctacgccgaagagagaccggaaccgagaaataatttgccggaagagcgtattcaagtggcgaagcctcagcttgcgcaaccgcagccggtgcaaacagagagtagcgataataagcacaccctttccatcaccaaagaagagctggcgaagcatcctgacttaattattcgcgggttgattccggcggtgctgcagaataatacggaggcggtggaactgctgttgccgttataccagaatctgccacagcaggatccatttttattagcttgggcggaggccattatagcgaccaaacaagggaattattcccgtgcggtgcaggaatatcgcactttgtttgcacaacgtcccgatattttgcagttgcgttatcaattagcgcacgcgttatttttgaataatgataacgaagcggcaaaagatcagttccaaaaactccgtgcggaagtgaatgatgaacaatcgcagcacgtgatcgatcagtatttaacggcgatcaaccaacgtgatcaatggagaatcagcggcggtattagttttttaaatgaatcgaacgtcagtaatgcaccaaaagcgggcacacgtatcggtggctggcaggcgtggcagcgcgaatcggcacacgggctttcttattatctcagtagtgaaaagaaatggtcgctgccgaaaaatgtcttcgccaagtttattttggacggacaaggcaaatattattgggataacaagaaatataacgaattcaacgcccgtatcggggcaggcttgggctatcaaacggcaaataccgaagtggtgttgttgcctttcaccgaacgtcgttggtattccggcggatcttccggcagtgatgctatgaagcaattttctaaaaactccggtgtacgttttgaattaagccattggttccataaaatgtggcaaatttccaccgcacttgagtatggcgaacagcgttatgtgaagcgcaaacatttaagcggcaataattatttgtggtcgaacaccttgttattcctgccttacagcgggcaatattggtttgccggggtggattacaaccgcgaaaatacccgtgatagcgataatgcctatcagcgtaaaaatcttcgtttgggctgggtgcaggaatggccgttgggcatttctacccgcatttcccttgcctatgccagacgaacttataacaacattgatttctttagcattcgccaaaaaaataacgaatatcaagccgcacttactgtatggcatcgtaacctgtactttttgggcatcactcctaaattaacctggtcgtatcaaaaaaacgacagcaatcatccgttttatcgttatgataaaaaccggatttatttagaaatgagcaaaaccttttaa

SEQ ID NO: 2 - protein, 480 aa, A. actinomycetemcomitans
MKLNHSFFFFALSLAATSMVYAEERPEPRNNLPEERIQVAKPQLAQPQPVQTESSDNKHTLSITKEELAKHPDLIIRGLIPAVLQNNTEAVELLLPLYQNLPQQDPFLLAWAEAIIATKQGNYSRAVQEYRTLFAQRPDILQLRYQLAHALFLNNDNEAAKDQFQKLRAEVNDEQSQHVIDQYLTAINQRDQWRISGGISFLNESNVSNAPKAGTRIGGWQAWQRESAHGLSYYLSSEKKWSLPKNVFAKFILDGQGKYYWDNKKYNEFNARIGAGLGYQTANTEVVLLPFTERRWYSGGSSGSDAMKQFSKNSGVRFELSHWFHKMWQISTALEYGEQRYVKRKHLSGNNYLWSNTLLFLPYSGQYWFAGVDYNRENTRDSDNAYQRKNLRLGWVQEWPLGISTRISLAYARRTYNNIDFFSIRQKNNEYQAALTVWHRNLYFLGITPKLTWSYQKNDSNHPFYRYDKNRIYLEMSKTF

SEQ ID NO: 3 - DNA, 1440 bp, A. aphrophilus
atgaaactaacacatcatgctttatttttggccgtcttgactttgacggcgacagccgcagctgaagaaaaggtggcacagcctaaaaataacttgcccgaagaacgtattcaaatcgctgaaccgcaattaccgcagccattgcaggtggaaaagacggcagataacaaacacatcctatctattaccaaaaaagaactggcaaaacgaccggatttaattattcgcgggttgattccggcggtgctgcagaataatacggaagcggtggaattgctgttgccgttataccaaaatctgccgcagcaggatccatttttgttagcttgggcggaggccattattgcaacaaaacaagggaattattcccgtgcggtgcaggaatatcgcaccttgtttgcacaacgtcccgatattttgcctctacgttatcaattagcacacgtattgtttttaaataatgataacgaagcggcaaaagatcagtttcaaaaactccgtgcggaagtgaatgatgggcaatcgcagcatgtgatcgatcagtatttaacggcgatcaaccaacgtgatcaatggagaatcagcggcggtattagttttttaaatgaatcgaacgtcaataatgcaccaaaagcgggtacacgtatcggtggctggcaggcgtggcagcgcgaatcggcccacggactttcttattatctcggtagtgaaaaaaaatggtcgctgccaaaaaatatcttcgccaagtttatttgggacggacaaggcaaatattattgggataacaagaaatataacgaattcaatgcacgtgtcggggcgggcttgggctatcaaacggcaaataccgaagtggcgttgttgcctttcaccgaacgtcgttggtattccggcggatcttccggtagtgatgctatgaagcaattttccaaaaactccggcgtccgttttgagttaagctattggttccataaaatgtggcaaatttccaccgcacttgagtatggtgaacagcgttatgtaaagcgaaagcatttaaacggcaataattatttgtggtcaaacaccttgttattcctgccttacagcgggcaatattggtttgccggtgtggattacaaccgcgaaaatacccgtgatagcgataacgcctatcagcgtaaaaatcttcgtttgggctgggtacaggaatggccattgggcatttctacccgtatttcccttgcctatgctagacgaacttataacaacattgatttctttagcattcgccaaaaaaacaacgaatatcaagccggacttaccgtatggcatcgtaacctatactttttgggcatcactcctaaattaacttggtcgtatcaaaaaaacgacagtaatcacccattttatcgttatgataaaaatcggatttatttagaaatgagcaaaaccttttaa

SEQ ID NO: 4 - protein, 479 aa, A. aphrophilus
MKLTHHALFLAVLTLTATAAAEEKVAQPKNNLPEERIQIAEPQLPQPLQVEKTADNKHILSITKKELAKRPDLIIRGLIPAVLQNNTEAVELLLPLYQNLPQQDPFLLAWAEAIIATKQGNYSRAVQEYRTLFAQRPDILPLRYQLAHVLFLNNDNEAAKDQFQKLRAEVNDGQSQHVIDQYLTAINQRDQWRISGGISFLNESNVNNAPKAGTRIGGWQAWQRESAHGLSYYLGSEKKWSLPKNIFAKFIWDGQGKYYWDNKKYNEFNARVGAGLGYQTANTEVALLPFTERRWYSGGSSGSDAMKQFSKNSGVRFELSYWFHKMWQISTALEYGEQRYVKRKHLNGNNYLWSNTLLFLPYSGQYWFAGVDYNRENTRDSDNAYQRKNLRLGWVQEWPLGISTRISLAYARRTYNNIDFFSIRQKNNEYQAGLTVWHRNLYFLGITPKLTWSYQKNDSNHPFYRYDKNRIYLEMSKTF

SEQ ID NO: 5 - DNA, 1491 bp, A. baummannii
atgaaaaaaacattgctgtgctgtgtgattttactggctgcttcatcactctatgccgatgatgagacacaactccgccttaatcaaagtctggatcagaatctgttccagcaacagcatcaattacaacaacaaggcaccattcgtgacaccgagaaactgcccagtatccgtattaatggccaaatttacgcggtagaacaaaatccggatgatctggccaaagcgctatatctggcggtcatgcaaaagcaatggggcaatgctgcgatttacttaaaacactatcagcagtatcaaggctatgatcaggctttaaccgattttgccgaagcggccttggcgcgcgctcagggaaagctcaaattagccgaacaaaaatttcaaagcagtcttaatcaacaacccaataatctgatttgtgaactcgagttagcgcgcgtgctgtttgaacagcagaagaataaacaagcagcacgcctttttacatcgattcaggacaagctagggcagagcaatggtgcaatgatcccaccagaagtgcaacaaacgattgatctgttcgtcaaagcacttgatcagcgagattcgtggcaaggcagtgtcgcaattggcccatcctatgccacaaatctgaatagttcttcggaacaaagcaaaacatggacgttgtatggcattgatgacaagggcaaggcgactccaattcaggaaattacccgcggcagccccaaagcagcatcagcaacagggattgactatgaggccagtctaatcaagcgcttttcgctttcgggcaatcatggcatttccttacgcggtttagcatttgggcaatcctatgctgatcatgcgctctataacgaatccaccctgaatatcaatgcaggctatagtttttttgatttaaaaaatcaaatcaccattgcaccgctatttgagcacaaacgttatgccaatgatggtttatacaatgcatggggggcacgtactgaatggatgcgatttctagcaccagacaaagccttcaagcttgaagctgaaatcaaggatctggactatcaaaagtataaaaacctagatggtaaagaaagctcggcaatgtttacattctggaaaattctaccgcagcaatggacactttttagcggactggatgtactggatcatgacacccaggaaaaatatatggcggcttatcagcaacaaggcatccgtctaggactgagcaaatcctggaaagcaggtttgaataccacgctattaacctcataccgctggcggcagtttgaccgctacgtcgagacctttgctgcacgtcgccatgattttgaacagaactataccctggttgtacaaatgccacggtttaagttttatggtatgacgccgaatttgacctatcgctacaaccataatgacagtaatgtcgactggctctattcctacgataaacacaatatcagcttaaagctggaacatcgtttttag

SEQ ID NO: 6 - protein, 496 aa, A. baummannii
MKKTLLCCVILLAASSLYADDETQLRLNQSLDQNLFQQQHQLQQQGTIRDTEKLPSIRINGQIYAVEQNPDDLAKALYLAVMQKQWGNAAIYLKHYQQYQGYDQALTDFAEAALARAQGKLKLAEQKFQSSLNQQPNNLICELELARVLFEQQKNKQAARLFTSIQDKLGQSNGAMIPPEVQQTIDLFVKALDQRDSWQGSVAIGPSYATNLNSSSEQSKTWTLYGIDDKGKATPIQEITRGSPKAASATGIDYEASLIKRFSLSGNHGISLRGLAFGQSYADHALYNESTLNINAGYSFFDLKNQITIAPLFEHKRYANDGLYNAWGARTEWMRFLAPDKAFKLEAEIKDLDYQKYKNLDGKESSAMFTFWKILPQQWTLFSGLDVLDHDTQEKYMAAYQQQGIRLGLSKSWKAGLNTTLLTSYRWRQFDRYVETFAARRHDFEQNYTLVVQMPRFKFYGMTPNLTYRYNHNDSNVDWLYSYDKHNISLKLEHRF

SEQ ID NO: 7 - DNA, 1491 bp, A. baylyi
atgaaacgaacgcttttgtgctgtctgacattgttgagttgtccatttttatatgccgacgaagacacacagcttcgtctcaatcaaagcttggaccaaacgcttttacaagaacagcgccagtttcacgagcagggaaccattcgtagtaccgagcaattaccaaaacttcaaattaatggacaagaatacagtattgaacaaaaccagaatgatcttgccaaggcgttatatttggcagtcatgcaaaaacagtggctcaaagccacggtttatttagaacattataagaaatatgttggctacgatcgggctttaaccgactttgccgaaggggcagttgcacgttctcagggtcaactgaaattggctgaacaaaaatttcaaagcagcctaaaacaacaacctcataatttaatttgtgaacttgagttagcgcgcgtgctgtttgaacaacagaaaaataaggaagcagcacgcctttttatttccattcaagatcaacttaaacaaagtgaccctgcggtaatcccgtctggagttttaaccacagtgaatacttttgttcaggcattaaaagaacgagactcttggcaaggctcggtttcagcgggttatacctatgtcagtaatttaaatagttcttctgaacagagtaaaacatggacgctttatggcaaagatagtaacggtaatattatcccaattgagcaagttacccgtgggacgcctaaagctgaatcggcaacgggtttagattacgaagccagtcttataaaacgctatgcgattaaggggcatcatggcgtggctttacgtgcgctggcgtttggacagtcctataacgaccacgcggcatttaatgaatctaccgttaacattaatgctggctacagctactttgacttaaaaaatcaaattggggtgagtccgctttttgaacataaacgttatggcaatgatggcctttacaatgcgtggggcgcgcgtgccgagtggatgcattttatctcagcagataaagccttcaagcttgaagctgagagtaaagatttaaattatcagaaatataaaaccctagatggggtagaaagttcagcttttgttactttctggaaaatcctcccaaatcagtggaccgtttttagtggtttagacgtagtcgaccattcgacccaagaaaaatatatggctgcataccagcagcaaggtgtgcggttgggcttaagcaaatcttggagcacaggatttaataccactttgctgagttcttatcgttggcgtatgtttgataaatatgcagaaactttcttagctcgtcgtcatgattttgaacagaactatacctttgtcgtgcaaatgccgcgctttgagttttatggcatgacgcctaatttaacctatcgctataaccataataaaagcaatgtcgattggctctattcctacgataaacacaacattagcctcaagcttgagcaccatttttag

SEQ ID NO: 8 - protein, 496 aa, A. baylyi
MKRTLLCCLTLLSCPFLYADEDTQLRLNQSLDQTLLQEQRQFHEQGTIRSTEQLPKLQINGQEYSIEQNQNDLAKALYLAVMQKQWLKATVYLEHYKKYVGYDRALTDFAEGAVARSQGQLKLAEQKFQSSLKQQPHNLICELELARVLFEQQKNKEAARLFISIQDQLKQSDPAVIPSGVLTTVNTFVQALKERDSWQGSVSAGYTYVSNLNSSSEQSKTWTLYGKDSNGNIIPIEQVTRGTPKAESATGLDYEASLIKRYAIKGHHGVALRALAFGQSYNDHAAFNESTVNINAGYSYFDLKNQIGVSPLFEHKRYGNDGLYNAWGARAEWMHFISADKAFKLEAESKDLNYQKYKTLDGVESSAFVTFWKILPNQWTVFSGLDVVDHSTQEKYMAAYQQQGVRLGLSKSWSTGFNTTLLSSYRWRMFDKYAETFLARRHDFEQNYTFVVQMPRFEFYGMTPNLTYRYNHNKSNVDWLYSYDKHNISLKLEHHF

SEQ ID NO: 9 - DNA, 1491 bp, A. beijerinckii
atgaaaagaacattgctgtgctgtctgactttattggctgcttcatcactctatgcagatgatgatactcaactgcgcctgaatcaaagcttagatcaaaatttattacaacaacagcatcaactacaacaacaaggcacaattcgtgataccgagaaactacccagtattcttatcaatggccaaatttttgcggtagagaaaaatcaggatgatttggcaaaagctctgtatttggcagtcatgcaaaaacaatggggcaatgctgcggtttatttaaagcattatcagcaatatcaagactatgatcaggctttaactgattttgccgaaggggcattggcacgtgctcaggggcaactcaaattagccgagcaaaaatttcaaagcagtctcaataaacaacccaataatctgatttgtgaactagagttagcgcgcgtgctgtttgaacagcagaagaacaaagaagcagcacgcctttttacatcaattcaaaacaaactgggacagagtgatcgtgcggtgataccgccagaagtagaacaaacggttaatctgttcgtcaaagcactcgatcagcgggattcatggcaaggcagtgtcgcgataggtccatcctatgccacaaatctgaatagttcttctgaacaaagtaaaacatggacgttatttggcattgacgataagggcaatgcgactcccattcaagaaattacccgtggcagccctaaagcagcatcagcaacaggtatggactatgaaaccagtttaatgaaacgcttttctctctacggcaatcatggggtttccttacgtgggttagcttatggacaatcttatgatgatcatgctgactataacgaatccaccttaaatattaatgcaggctatagttttttcgatttaaaaaatcagatcagcattgcaccattgtttgaacataaacgttatgcaaatgacggtttatataatgcatggggtgtacgtgctgaatggatgcgatttattgccgcagacaaagcattcaaactcgaagctgaaatcaaagatctggactaccaaaaatataaaacattagatggtaaagaaagctcagcgatgttcacgttttggaagattctacccaagcaatggacattatttagtggactagacgtgcttgatcatgacactcaagaaaaatatatggcggcctatcaacaacaaggggtccgtttagggttgaggaagtcttggaatgttgggttgaataccactttattcacttcgtatcgctggcggcagtttgatcgctatgctgaaagtctagaagcccgtcgtcatgattttgaacaaaattatacctttgttgtacagatgcctcgatttaaattttatggtgtgacgccaaaccttacttatcgttataaccaaaacagtagcaatgtggattggttgtattcttatgagaaacataatgttagcttgaagcttgagcatcgtttttag

SEQ ID NO: 10 - protein, 496 aa, A. beijerinckii
MKRTLLCCLTLLAASSLYADDDTQLRLNQSLDQNLLQQQHQLQQQGTIRDTEKLPSILINGQIFAVEKNQDDLAKALYLAVMQKQWGNAAVYLKHYQQYQDYDQALTDFAEGALARAQGQLKLAEQKFQSSLNKQPNNLICELELARVLFEQQKNKEAARLFTSIQNKLGQSDRAVIPPEVEQTVNLFVKALDQRDSWQGSVAIGPSYATNLNSSSEQSKTWTLFGIDDKGNATPIQEITRGSPKAASATGMDYETSLMKRFSLYGNHGVSLRGLAYGQSYDDHADYNESTLNINAGYSFFDLKNQISIAPLFEHKRYANDGLYNAWGVRAEWMRFIAADKAFKLEAEIKDLDYQKYKTLDGKESSAMFTFWKILPKQWTLFSGLDVLDHDTQEKYMAAYQQQGVRLGLRKSWNVGLNTTLFTSYRWRQFDRYAESLEARRHDFEQNYTFVVQMPRFKFYGVTPNLTYRYNQNSSNVDWLYSYEKHNVSLKLEHRF

SEQ ID NO: 11 - DNA, 1491 bp, A. bereziniae
atgaaaaaaatagtattgcttggcgttgtggtactgtgtggagaatctgtctatgcagcggatgataccagtatcaggttaaatcaggaaattagtcagcaacaatatcaaaatgataagaaactactcaaatcagatgatcccaaaaaagaccaagcattaccgaatctgatcatacaaggtcaggaatatatggtgaaggatgaacccgcagaagttgcttatgcgctttatttggcagtgatgcaaaaacaatggcatgtcgctttacgttatttagaaaaatataaaaaatttccaaattatgatcaggctttgactgaattcgctgaaggcgtcatggcacgaacacagggaaatttaagcttagctgaaagtaaactacaacacagtctaaagattcaatccaataatttaatgactcagcttgagctggcgcgtgtctacaccgaacaacaaaaaaatcagcaaggactacagttatttcagcagattcaatctcaattaactatgtctaacgatcctactgctcaaggtattcttcaaactgtagagatgtatcttaaaggacttaaacaacgtgatgcatggcaaggttctttagcttttggttcacgttatgccaataatatcaataacgcttcggataaatacgacatcgtgacctattacggtattgacccagaaaccaaggaagtcgtgcctgtcgaacaattaaagcgaggtacaccagatgcgatcagtgcccaaggtctggattatgaagccactttaaccaagcgttggtcactttctgggcagcatggtattgctttacgtggattattctatggtcaagtttacccagatcagacagattataatgaattaacttttaatttaaatgcgggttatagtttttataatgaacgtaatcaagtcttggttgctcctgtatttgaacataaatactatgcacatgatccactctacaatgcttatgggttaagaggcgagtggatgcgctttatttccaacgataaagccgtcaagttagaggctgaaatgaaagatatgaactattctcagtataaggggcagaatggcacggaatactcagtctattcaactttttggaaaattttaccaaaaaactggaccttatttggtggactcgatttcgttgaccataatacccaagagcaatatttcacagcatatcaacaacaaggcatacgtttagggttgtccaaaaattttaccgcaggctttaacaccaatttatttagttcttttcgttggcgtcaatttgataaatttacgcctgtattagagactaggcgacatgattttgaacaaaactataccttgattttaagtgcaccgcgttgggccttttacggtttaacaccaaatctcacttatcaatataatcaaaataacagtaatgtagagtggttgtattcttatgataaacacaatatcagcttaaagttagaacatcgtttttaa

SEQ ID NO: 12 - protein, 496 aa, A. bereziniae
MKKIVLLGVVVLCGESVYAADDTSIRLNQEISQQQYQNDKKLLKSDDPKKDQALPNLIIQGQEYMVKDEPAEVAYALYLAVMQKQWHVALRYLEKYKKFPNYDQALTEFAEGVMARTQGNLSLAESKLQHSLKIQSNNLMTQLELARVYTEQQKNQQGLQLFQQIQSQLTMSNDPTAQGILQTVEMYLKGLKQRDAWQGSLAFGSRYANNINNASDKYDIVTYYGIDPETKEVVPVEQLKRGTPDAISAQGLDYEATLTKRWSLSGQHGIALRGLFYGQVYPDQTDYNELTFNLNAGYSFYNERNQVLVAPVFEHKYYAHDPLYNAYGLRGEWMRFISNDKAVKLEAEMKDMNYSQYKGQNGTEYSVYSTFWKILPKNWTLFGGLDFVDHNTQEQYFTAYQQQGIRLGLSKNFTAGFNTNLFSSFRWRQFDKFTPVLETRRHDFEQNYTLILSAPRWAFYGLTPNLTYQYNQNNSNVEWLYSYDKHNISLKLEHRF

SEQ ID NO: 13 - DNA, 1491 bp, A. calcoaceticus
atgaaacgaacgcttttgtgttgtctgactgtgttgagttgtccatttttatatgccgacgaagacacacagcttcgtcttaatcaaagtttggaccaaacacttttacaagaacagcgccagtttcacgagcagggaaccattcgtagcaccgagcaattaccaaaacttcaaattaatggacaagaatatagtgttgagcaaaacccgaatgatcttgccaaggcgctatatctggcagtcatgcaaaaacagtggctcaaagccacggtttatttagaacattataaaaaatatgttggctacgatcgggctttaaccgactttgccgaaggggcagttgcacgttctcagggtcaactgaaattggctgaacaaaaatttcaaagcagcctaaaacaacaatctaataacttaatttgtgaacttgagttagcgcgcgtgctgtttgaacaacagaagaataaggaagcagcacgcctttttatttccattcaagacaaacttaaacaaagtgaccctgcggtaatcccgtctggggttttaacaacagtgaatacttttgttcaggcattaaaaaaacgagactcttggcaaggctcggtttcagctggttacacctatgtcagtaatttaaatagttcttctgaacaaagcaaaacatggacgctttatggcagagatagtgacggtaatattatcccaattgagcaagtcacccgtggaactccaaaagccgaatcggcaacgggtttagattacgaagccagtctgattaaacgctatgcgattgagggtcatcatggcgtggctttacgtgcgttggcttttggacagtcctataacgaccacgcggcatttaatgaatctactattaacattaatgcaggctatagctactttgacttaaaaaatcaaattggggtgagtccgctttttgaacataaacgttatggcaatgatggtctttacagtgcatggggcgcgcgtgccgaatggatgcattttatctcggcagataaagcctttaagcttgaagctgaaagaaaagatttaaattatcagaaatataaaactctggatggcgtagaaagttcggccttcgccactttctggaagatttttccagatcagtggactgtttttggtggtttagatgtagtcgaccattcgacccaagaaaaatatatggctgcataccagcagcaaggtgtgcggttgggcttaagcaaatcttggagcacaggatttaacaccactttattgagctcttaccgttggcgtctgtttgataaatatgcagaaactttcctagcacgccgccatgattttgagcagaactataccgttgttgtgcaaatgccgcgctttgagttttatggcatgacgcctaatttaacctaccgttataaccataataaaagtaatgtcgattggctgtattcctacgataaacacaacattagcctcaagcttgagcatcgtttttag

SEQ ID NO: 14 - protein, 496 aa, A. calcoaceticus
MKRTLLCCLTVLSCPFLYADEDTQLRLNQSLDQTLLQEQRQFHEQGTIRSTEQLPKLQINGQEYSVEQNPNDLAKALYLAVMQKQWLKATVYLEHYKKYVGYDRALTDFAEGAVARSQGQLKLAEQKFQSSLKQQSNNLICELELARVLFEQQKNKEAARLFISIQDKLKQSDPAVIPSGVLTTVNTFVQALKKRDSWQGSVSAGYTYVSNLNSSSEQSKTWTLYGRDSDGNIIPIEQVTRGTPKAESATGLDYEASLIKRYAIEGHHGVALRALAFGQSYNDHAAFNESTININAGYSYFDLKNQIGVSPLFEHKRYGNDGLYSAWGARAEWMHFISADKAFKLEAERKDLNYQKYKTLDGVESSAFATFWKIFPDQWTVFGGLDVVDHSTQEKYMAAYQQQGVRLGLSKSWSTGFNTTLLSSYRWRLFDKYAETFLARRHDFEQNYTVVVQMPRFEFYGMTPNLTYRYNHNKSNVDWLYSYDKHNISLKLEHRF

SEQ ID NO: 15 - DNA, 1464 bp, A. capsulatus
atgaaattaaaattacttatctctgcagttgcagtatctaccacattctcagcgcttgctgatactacagaacaaaaaatttccgaccatttaaacgatttacgaagccaaacggaagtagcgattgaatctcgtattcaaaagccggttgctcgttcacttcctcaatcaaccgttcagcaaaaaaagcttccaagtatgagcaaagaggagttcgctaagcgaccagatttaatttcaaatgcgcttgttttagcattacatcaatctaattctgatacggttaattttctttattcgttttatagcaaactgccagcacaataccaagacccgattatggttaagtggtcggaagctattttagcccgtcaaaaaggcgactacagtaccgccattgctctctatcgagaaatattagccgaacattcaggcttaggctctgctcgtttacagcttgctgtagcattatttgagaacaatgaattagaagccgccgaagatcaattccaaaaaatacgcgcagaaaatccgcctgcccagattaaagatgttatcgatcaatatattgccgcaatcgtaaataaagatcgatgggtattttccggtggattcacttatttaaacgatccgaatattaataacgccccgaaatctggcaccacttacggacaatggagcgcaccgaaatccgaatccgcacaagggatcggctttaacttctatgctggcaagaaatggtcttggggaaataatttctataatgaattccgtctaagcagtaacggaaaatattattggaataacaaaaaatataatgaagtcagcgcaagaggaagccttggtttaggctatcaaaccgctcgctttaatatggctattcttccttttatggaacaaacactttatgctggcggttcgaacagtagcaacagtttaaaacgattctcaaaaacaagcggcgcaacattagaaaccagttactggatctcaccgaaatggcaatgggaatcaaactatgaatatgccgaacaacgttatatggatcgtaaacatttaaatggtagctaccatttcgtttcaagtggcttaacttatcttgccagtgcaaaacaatattggtttactaatataaactacaaccgcacagcaactcgagataaggatgacagttatatccgccgcggaatcgcgcttggctggggacaagaatggccattcggtctatcaacacgattaagtgttaactatgcacaaaaaaattacaaagcaccaatgccaatctttggcattacacaacgtaataaagaatacggtgtatcattaagtctatggcatcgtgccatacattattggggtattacacctcgcctaacgtatagctttaataaagtaaaaagtaatcacgcattctatagctacgataaacaccgtatttttgtggagtttagcaaacgcttctag

SEQ ID NO: 16 - protein, 487 aa, A. capsulatus
MKLKLLISAVAVSTTFSALADTTEQKISDHLNDLRSQTEVAIESRIQKPVARSLPQSTVQQKKLPSMSKEEFAKRPDLISNALVLALHQSNSDTVNFLYSFYSKLPAQYQDPIMVKWSEAILARQKGDYSTAIALYREILAEHSGLGSARLQLAVALFENNELEAAEDQFQKIRAENPPAQIKDVIDQYIAAIVNKDRWVFSGGFTYLNDPNINNAPKSGTTYGQWSAPKSESAQGIGFNFYAGKKWSWGNNFYNEFRLSSNGKYYWNNKKYNEVSARGSLGLGYQTARFNMAILPFMEQTLYAGGSNSSNSLKRFSKTSGATLETSYWISPKWQWESNYEYAEQRYMDRKHLNGSYHFVSSGLTYLASAKQYWFTNINYNRTATRDKDDSYIRRGIALGWGQEWPFGLSTRLSVNYAQKNYKAPMPIFGITQRNKEYGVSLSLWHRAIHYWGITPRLTYSFNKVKSNHAFYSYDKHRIFVEFSKRF

SEQ ID NO: 17 - DNA, 1443 bp, A. capsulatus
atgcttaaaaaattagcgtttttatgtgcagttttattctatttagcgcgcgttggtgttgcttatgcagagcagcaaattaatacacctgaaaagaatatggaaattgctaaattacttaaagaatccaaaaaattacctgaattagttatagatacggcagaaaatattcaattttccgttcaaggtttattcagtaataaagtattgagcgaacaattactcaatcatgcaatagaaacaggtaacctttcttctattgaatacttattggcgatttatcgtcaatttcccgataccgatcctgttttaattctttttgcacaggcacaaattgccaaaatacagcaacaatatacgaaggcaagcaagttataccgtgacatattggcactaaaaccggaacttacgcccgttcgcatacagcttgccatcgtgttatttcaatctcaacaggacaaggcggctaaagagcagtttgaaaaagctttgagcgagccgcaacttcccattgatattgaacaattgattcatctttatttacaagcgctggaacaacgtaatacgtggcagctttcattaagcgctaattatttgcgagaagacaatgtaaataatgtttcaggcgaacgatatattgaaaataccgcctttataaaaggcgagagtatgttgccgcaaaaagcacaggggatcggttattactttggtttagagcgtgatatcaatttatggaatgcccattatttgcatatcgaaaatagtttatacggcaaaagttactgggatcagcatgattacgatgatattaccaatcgcttatcgttaggctatgtacataaaggctcacagcaacgctttgcgattttgccgttttatgaacagcaatggtatggtggtcatcgatataagcgcagtaatggcagcagaatagaatttaatcgttggctaacgtcaaattggcaattttcaacggctgcagagtatgctcggaatttctattcaaatagcccaagtttaaacggtaagagtaagttagcttcactaacgatgttatggcgcgctagtcctcgtacttatttttatttaggtgcggattacgctcaagaacgcactaaagttcgtcattacagctatgacttaaaaatagcccgtatcggttggggacaagaatggcattggggaatatcttctcgtttaagcttttcagcctctaagcgagagtataaggataatctttcgctcggttcggtttttcatttcgacaggcggcgtgaagaccgaatctatcatatcaatgcaaccgtttggaaaagagattggcatttatgggggattaccccaaagctcaattatcactggaaaaaacaacgtagcaattttgtaagcctttattcttactcggataaaagtatcaacataatactggaaaaaactttttaa

SEQ ID NO: 18 - protein, 480 aa, A. capsulatus
MLKKLAFLCAVLFYLARVGVAYAEQQINTPEKNMEIAKLLKESKKLPELVIDTAENIQFSVQGLFSNKVLSEQLLNHAIETGNLSSIEYLLAIYRQFPDTDPVLILFAQAQIAKIQQQYTKASKLYRDILALKPELTPVRIQLAIVLFQSQQDKAAKEQFEKALSEPQLPIDIEQLIHLYLQALEQRNTWQLSLSANYLREDNVNNVSGERYIENTAFIKGESMLPQKAQGIGYYFGLERDINLWNAHYLHIENSLYGKSYWDQHDYDDITNRLSLGYVHKGSQQRFAILPFYEQQWYGGHRYKRSNGSRIEFNRWLTSNWQFSTAAEYARNFYSNSPSLNGKSKLASLTMLWRASPRTYFYLGADYAQERTKVRHYSYDLKIARIGWGQEWHWGISSRLSFSASKREYKDNLSLGSVFHFDRRREDRIYHINATVWKRDWHLWGITPKLNYHWKKQRSNFVSLYSYSDKSINIILEKTF

SEQ ID NO: 19 - DNA, 1488 bp, A. faecalis
atgcatgggcgagcccttccccttttgtgcctgctgctggccatggcatccagcgcggtgcaagccaacgacgacgatacgcgccgacttctgaatcaaatcgaccgcaatctgaacgaacgtgaacgctcccatttagtggaagaaaccccgcccgatggggacccatcggccctgatcaccatcaacggcacaacctatagcgtcgatgccacgctgactgatctggaaccggccatttatgtcgccatcaatctgcagcagtgggccaaggtggatcagtttgtagaaaagtatcaggagctgcccggccacaaccctgccttggtgctgatggctcaaggggtggtggcccgtagcaaggacaatcacagcctggcgatcagcaagctgcgccgggctcaggaaagcgatcccactatgatgcgcgccaagctggagctggcccgcgtactgttcgaggactatcaatccagcgaagccaaggagctgttcagccagatttcctctaccggtattcctgatgaagtgcgactcgtgatcgaaggcttccagggtgccctgcaagaccgcaatgcctggcacggttctgcctcgattggcttgggctacaacagcaatatcaataaagaaaacggacagcaagacaccttctttacctgttatttctttgggtgctttccgtcggtgcgcaagatgccggacccggtcaaatccacggccatggtctacgacctgaccttgaaccggcgcttccagctaagcggcaaccacaatctgcttctgcgcggcctgagctacggcaatctgtacgacaagcataaggaagccaagcccaagaacatttattacagcgacaacaccagcattatttacgcgggctacaactatcaggacgctaaaaacgatctgtcgattacgcccttgttcgagaacaattacaccaaccgtcgcaccagctatcagtcctggggcgggcgcgtggactggaagcacaatcttagcgacaggctgcaagtgggcgtgaatgcccagcataagagcctgtcctacaaaggcgatttacggcagtactttgaaggcgtcaaagagaaccagataggcttgtacggctcgtatctgattgacgccaaaaccgtagtctacgggggcctgaattacacccgcaatctgcagtctcagcaaaccgcgcaaagccgcagctatatggcgaacctgggaatttacagggcctttgatgcaggctttaacatcaacgccacggcactgtaccggcagacccgtcacgatgcccaagacttgttcctgggtgggctgcgcaaggaccgccagcagatttatatcctgaacgtgggcatgccacgctttgcgttccaaggcattacgcccaatctgtatctgaagcacaccttcaacaacagcaacatcgactgggctttcaaatacaagcaaaccgaagtcgcgctgaagctggaaaagcggttttaa

SEQ ID NO: 20 - protein, 495 aa, A. faecalis
MHGRALPLLCLLLAMASSAVQANDDDTRRLLNQIDRNLNERERSHLVEETPPDGDPSALITINGTTYSVDATLTDLEPAIYVAINLQQWAKVDQFVEKYQELPGHNPALVLMAQGVVARSKDNHSLAISKLRRAQESDPTMMRAKLELARVLFEDYQSSEAKELFSQISSTGIPDEVRLVIEGFQGALQDRNAWHGSASIGLGYNSNINKENGQQDTFFTCYFFGCFPSVRKMPDPVKSTAMVYDLTLNRRFQLSGNHNLLLRGLSYGNLYDKHKEAKPKNIYYSDNTSIIYAGYNYQDAKNDLSITPLFENNYTNRRTSYQSWGGRVDWKHNLSDRLQVGVNAQHKSLSYKGDLRQYFEGVKENQIGLYGSYLIDAKTVVYGGLNYTRNLQSQQTAQSRSYMANLGIYRAFDAGFNINATALYRQTRHDAQDLFLGGLRKDRQQIYILNVGMPRFAFQGITPNLYLKHTFNNSNIDWAFKYKQTEVALKLEKRF

SEQ ID NO: 21 - DNA, 1449 bp, A. gerneri
atgagttcatccatacttcatgcagcagatgacgatacacgttttcgattggatcaagaattattacaacaaaaaaaacaacagcagcaacctttgcttcaacagcaaaagcaagatcaattaccgacgatggtcattgatggcgaaaaaatagaagtgaagaaaaatagcaatgaacttggacgagctttatacattgcagtgatgcaaaaacaatggcaagcagccagtatatatttggaacattatttaaaactaaacgatcatgatccctctttggtttattttgcacaaggtgctttgcaacgtgtgcaaggcaacttgtctcaagcagagcatgattttaaacaggcactagatttacagccgcaaaatgcgatgatcaaattggagttggcacgactctataccgaaagacaaaaaaataatgaagctaaacagctctttgaacaagttaaacatcaattgggggatacagtcgatcctacgctgttaaatattcatcatgcgattgatatatatctagatggtttgaaaaaacgtgatgcttggcagggttctatcaatttgggtatacgttatgcaaccaatatcaatagtgcgaccgagaaaacaacaacttggacgacatttggcaaagaccaaaatggcaatattattccgatacaaattacacgcggtacacctgatccaattgatgcgacagcctttgattatgagggaactttgagtaaacgatggtcactgcaagaaaatcatggcttggcacttaaagcctttgcttatggccgtgtttttgatgggcataaagattttaatgaaatgacactcaatctaaatgcagggtatagctttcaaaatcaacgtaatcaaatcttagtcgcccctgtttatgagcatagacgttatagcaatgaaacattttcaaatgcttggggcgggcatttagagtggatgcattttcttggacatgacaaagcatttaaattagaaacagaaataaaagacattaacaatacaaaatattcgactcaaagtggtcttgaaagttcggtctatagcactttctggaaagtattacctcagaactggacagtctttactggtctggattttacggatcatcgaagcaaagaaaaaatctttaatcaataccaacagcaaggcatacgttttggattttccaaacaatggaatactggttttaatgcaacagcatttagttcttttcgatggcgtcaatatgcaacacaaaatcaagttttaggcggtgaacgccgtcatgattttgaacaaaactatacagtggtactgtcagcacctcgatggcaattttatggtgtgattccaaatttgacttatcaatataataacaacctgagtaatattgattggctctatagctacgacaaacacaatgtaagtttaaggctcgagtatcggttttaa

SEQ ID NO: 22 - protein, 482 aa, A. gerneri
MSSSILHAADDDTRFRLDQELLQQKKQQQQPLLQQQKQDQLPTMVIDGEKIEVKKNSNELGRALYIAVMQKQWQAASIYLEHYLKLNDHDPSLVYFAQGALQRVQGNLSQAEHDFKQALDLQPQNAMIKLELARLYTERQKNNEAKQLFEQVKHQLGDTVDPTLLNIHHAIDIYLDGLKKRDAWQGSINLGIRYATNINSATEKTTTWTTFGKDQNGNIIPIQITRGTPDPIDATAFDYEGTLSKRWSLQENHGLALKAFAYGRVFDGHKDFNEMTLNLNAGYSFQNQRNQILVAPVYEHRRYSNETFSNAWGGHLEWMHFLGHDKAFKLETEIKDINNTKYSTQSGLESSVYSTFWKVLPQNWTVFTGLDFTDHRSKEKIFNQYQQQGIRFGFSKQWNTGFNATAFSSFRWRQYATQNQVLGGERRHDFEQNYTVVLSAPRWQFYGVIPNLTYQYNNNLSNIDWLYSYDKHNVSLRLEYRF

SEQ ID NO: 23 - DNA, 1491 bp, A. guillouiae
atgaaaaaaatagtattgcttggtgccgtattgcagtgtggacaatgtgtttatgcagcggatgataccagtatcaggttaaatcaggaaattagccaacagcaatatcaaaatgataagaaactactcaaatcagaagaccctaagaacacacaagcattaccgaatctgatcatacaaggtcaagaatatgtggttaaggatgaacccgcagaagtcgcatatgcactttacttggcagtgatgcaaaaacaatggcaagtggctttaagctatcttgaaaaatataaaaaatttccaaattatgatcaggctttgactgagttcgctgagggcgtcatggcacgaacacaggggaatttaagtttagctgagagtaaacttaaacatagcctagagattcaatccaataatttaatgacccaacttgagctggctcgtgtctacaccgaacaacaaaaaaatcagcaaggtcaacagttattcctgcagattcaatctcaactggctctgtctacagatcctgctgcccaaggtattggtcaaaccgtagagatgtatctcaaagggcttaaacaacgagatgaatggcatggttcattggcgtttggttcacgttatgccagtaatgttaataatgcttccgataaatacgacatcattacgtattatggcattgaccctgagactaagaaggtcgttcctattgaacaagtaaagcgtggcacacctgacgcgatcagtgcgcaaggtttggattatgaagcgaccttaactaaacgatggtcgctttctggacaacatggtattgcattgcgtggattattctatggtcaagtttatccagagcagacagattataatgaattaacttttaacttaaatgcgggttatagttattacaacgaacgtaatcaaatcttgatagcacccgtatttgaacataaatactatgcccacgacccgctgtatagtgcctatgggttaaggggcgagtggatgcgttttatctctaacgacaaagctgtcaagttagaagccgaaatcaaagatataaattattcccagtataaaggccaagatggcgtggaatattcagtctattcaaccttttggaaaattttaccgagaaactggacgctatttggcggactggattttgtcgaccataatacccaagaacaatattttacggcttatcaacaacaagtcgtgcgtttgggcctttccaaaaactttgactcaggttttaacgcaaatttatttagttctttccgttggcgtcaatttgataaatttactccagtgttggaggctagacgacatgattttgaacaaaattatactttaattctaagtgcaccacgctgggctttttatggtttaacacctaatctcacttatcaatataatcaaaataacagcaatgtagagtggctatattcttatgataaacacaatgtcagtttaaagctggagcatcggttctaa

SEQ ID NO: 24 - protein, 496 aa, A. guillouiae
MKKIVLLGAVLQCGQCVYAADDTSIRLNQEISQQQYQNDKKLLKSEDPKNTQALPNLIIQGQEYVVKDEPAEVAYALYLAVMQKQWQVALSYLEKYKKFPNYDQALTEFAEGVMARTQGNLSLAESKLKHSLEIQSNNLMTQLELARVYTEQQKNQQGQQLFLQIQSQLALSTDPAAQGIGQTVEMYLKGLKQRDEWHGSLAFGSRYASNVNNASDKYDIITYYGIDPETKKVVPIEQVKRGTPDAISAQGLDYEATLTKRWSLSGQHGIALRGLFYGQVYPEQTDYNELTFNLNAGYSYYNERNQILIAPVFEHKYYAHDPLYSAYGLRGEWMRFISNDKAVKLEAEIKDINYSQYKGQDGVEYSVYSTFWKILPRNWTLFGGLDFVDHNTQEQYFTAYQQQVVRLGLSKNFDSGFNANLFSSFRWRQFDKFTPVLEARRHDFEQNYTLILSAPRWAFYGLTPNLTYQYNQNNSNVEWLYSYDKHNVSLKLEHRF

SEQ ID NO: 25 - DNA, 1491 bp, A. gyllenbergii
atgaaaagaaaattgctgtgctgtttgattttattggcgaattcatcactctacgcagatgatgagacacaactgcgcctgaatcaaaacttggatcagaatttattacaacaacagcaccaactacaacaacaaggggcaattcggagcaccgatgaactaccgaatattgtgattaatggtcaagtatttgaggttgagaagaaccaagatgatcttgcaaaagctttatatttggcggtcatgcaaaagcaatggggtaatgctgctgtttatctaaagcattatcaacaatatgatggctatgaccaagcattaacagattttgccgagggagcattggctcgtgcgcaaggccaactcaaattagccgaacaaaaatttcaaagcagcctcaataaacaaccgaataaccttatttgtgaacttgagttagcgcgcgtgctgtttgaacagcagaagaacaaacaagcagcacgcctttttacatcgattcaaaacaaattggggcagagtgatcgtggtgtgattccaccagaggttgaacaaacggttaatctgtttgtcaaagcacttgatcaacgtgatgcatggcaaggcagtgtcgcaattggtccatcctatgccacgaatctgaatagttcttctgaacaaagcaaagtatggacgctatatggctttgacaaagatggtaaggtcattcctgttagagaaattacccgcagtagccctaaagctgagtcggcaacaggtgtggactatgaagccagtttaatgaaacgcttttctctgtatggcaatcatgggctctccttacgtggtttggcttatggacagtcttatgacgatcgtgccgactttaatgaatccactctcaatatcaatgctggctatagtttttttgatttaaaaaatcaaatcaccattgcaccgttatttgagcacaaacgttatgccaatgatggcctatacaatgcttggggcgcgcgcgcagaatggatgcgattcatttccgctgataaagcactcaagcttgaagctgaaatcaaagatttaaattatcaaaaatataagaccctagatggtaaagaaagttcagctatgctgaccttttggaagattctacctgaacaatggaccttatttggtggcttggatgtcttagatcatgatacccaagaagaatacatggcggcgtaccagcaacaaggtgttcgtttaggtctgagtaaaccgtggagtgctggctttaataccactttattcagtttgtatcgttggcgacagtttgatcgttacgtggcggcatttcaaacacgccgtcaagattttgagcaaaactacacctttgtgttgcaaatgcctcgtttcaaattctatggtgtgacgccgaatctaacctatcgctataaccgtaataacagcaatgtggattggttatattcctatgacaaacacaatgtcagcctaaaactagagcaccgtttttag

SEQ ID NO: 26 - protein, 496 aa, A. gyllenbergii
MKRKLLCCLILLANSSLYADDETQLRLNQNLDQNLLQQQHQLQQQGAIRSTDELPNIVINGQVFEVEKNQDDLAKALYLAVMQKQWGNAAVYLKHYQQYDGYDQALTDFAEGALARAQGQLKLAEQKFQSSLNKQPNNLICELELARVLFEQQKNKQAARLFTSIQNKLGQSDRGVIPPEVEQTVNLFVKALDQRDAWQGSVAIGPSYATNLNSSSEQSKVWTLYGFDKDGKVIPVREITRSSPKAESATGVDYEASLMKRFSLYGNHGLSLRGLAYGQSYDDRADFNESTLNINAGYSFFDLKNQITIAPLFEHKRYANDGLYNAWGARAEWMRFISADKALKLEAEIKDLNYQKYKTLDGKESSAMLTFWKILPEQWTLFGGLDVLDHDTQEEYMAAYQQQGVRLGLSKPWSAGFNTTLFSLYRWRQFDRYVAAFQTRRQDFEQNYTFVLQMPRFKFYGVTPNLTYRYNRNNSNVDWLYSYDKHNVSLKLEHRF

SEQ ID NO: 27 - DNA, 1488 bp, A. haemolyticus
atgaaaaaaacactgatgtgttgcctgatattactgagttgtccatatttatatgctgacgatgatacgcaactacgtctaaatcagagcctagatcaacatttattacaacagcaaagagaacttcaaaaacaaggtacgattcgcagcactgaggaattacccgatattcatatcaatggaaaagtgtatgtggtcgagaaaaaccaagatgatttagccaaagctttatatctcgctgtaatgcaaaagcaatggacgaatgttcaaatttatctgacgcattatcaacaatatcctgattatgatcaggcgttaactgattttgcagaagcagccttggcacgtacccaagggcaattaaaattagctgaacaaaaattccaaagcagtttaaataaacaaccgaacaatctaatttgtgaactcgagttagcgcgtgtgctgtttgaacaacagaagaacaaagaggcagcacacctttttataacgattcaaaataaattgaaacaaagtgatcacagtgtcattccgccagaagtacaaaaaacggttcagcttttcgtcaaagcgcttgctcaacgagatgcatggcaaggttctattgctataggtccgacttatgcgagtaatctaaacagttcatcagaacaaagtaaaacttggacgctgtatggcatggataaagatggcaacattatcccagctcaaattacacgaggaagtccaaaagcagtttcagcaaatggtatagattatgacgcaagcctaatcaaacgtttttccatcaaagaaaatcatggcgttgcactacgtgctctagcttatggacagtcctacgataaccaaagcaattataacgaatccaccatcaacgtaaatgcaggttatagctattatgatttaaaaaaccaaattaatttcagcccactatttgaacacaaacgttatggcaacgagagtttgtacgatgcttggggcgggcggattgaatggatgcgatttatttcgggcgataaagcactcaaacttgaagcagaaattaaagattttgattaccacacctataaaacactcaatgggcaagagcgttcggtactggcgactttttggaaaattttactagaacaatggacattatttggtggactcgacctccttgatcgttcgacacaagaacaatatatcgcggcttaccagcaacaaggaattcgtctaggtataagtaaaccatggaatattggaattcatacaacattattaagtacttatcgttggcgacaatttgataaatacgcaaaggtttatgaagcaagacgacatgattttgaacaaaattatacgtttgttgtgcaaatgccacgcttcaaattttatggcgtaacaccgaatttaacgtatcgttataaccacaatgatagcaatgtggattggttgtacacctatgacaagcacaatgtcagcctgaaactcgaacaccgtttctag

SEQ ID NO: 28 - protein, 495 aa, A. haemolyticus
MKKTLMCCLILLSCPYLYADDDTQLRLNQSLDQHLLQQQRELQKQGTIRSTEELPDIHINGKVYVVEKNQDDLAKALYLAVMQKQWTNVQIYLTHYQQYPDYDQALTDFAEAALARTQGQLKLAEQKFQSSLNKQPNNLICELELARVLFEQQKNKEAAHLFITIQNKLKQSDHSVIPPEVQKTVQLFVKALAQRDAWQGSIAIGPTYASNLNSSSEQSKTWTLYGMDKDGNIIPAQITRGSPKAVSANGIDYDASLIKRFSIKENHGVALRALAYGQSYDNQSNYNESTINVNAGYSYYDLKNQINFSPLFEHKRYGNESLYDAWGGRIEWMRFISGDKALKLEAEIKDFDYHTYKTLNGQERSVLATFWKILLEQWTLFGGLDLLDRSTQEQYIAAYQQQGIRLGISKPWNIGIHTTLLSTYRWRQFDKYAKVYEARRHDFEQNYTFVVQMPRFKFYGVTPNLTYRYNHNDSNVDWLYTYDKHNVSLKLEHRF

SEQ ID NO: 29 - DNA, 1191 bp, A. insuavis
atgcgcttctacccctggatggccggcgtcgacccgatcctgcgcgactacgtccatggcgcgctgctgcgccacgatgggcgcctagccgaggccatcgcgctttaccgccagttgatcgcgcgacatcccgacctggactacgtcagactggaactagccaccatgctgatggaggaccgccaattcgcgcaatccgacgccgagctggccgacctgcgcctggcatcgctggagccggcggcgcagcgcagcgtgatgcagtaccggcaggcgctggagcagcaacgccgctggaatttccgcctgggcgcgggcaccgtctacagcgacaacgtcaactcggccaaccgcgatccgatgttgtatctgccggtcgcgacgcggcgcgggccactgtgggtgccattcgccaagagccgggatgccctgcccaaatcggattggggcttgaagtacagcggcagcgccaatgtcgagcgcaatctcggcggacaccactactacacgctgggcgcggatatcgatggcaccgcctaccgcgtgcagcgcgactacagcgaccgcgccctgacgctgcgcggcggctacaagtggcaggacgccacgcgttggttcgccgcgacgccgcaggcgggccgcagctggatgggcagccggcgctacagccacaaccacggcatgagcctggaatacggttggcggccaacgcccgggtggcaattgatgggggcctggctatggctcaagcgcggctatgacgaccgcgcctacgccgcctacgacggccacctggaggtgctgtcgttgacggcgatccgcgtcttctcgccggcgctgctggcctacggcagcgttggcctgcagcgcgaggcagtggcggcgggcgagtacagctatcgcttcccctgggcacagctcggcgtgatcaagaccttcgggcgggtgctcggcgcgcgcttgagcgcccgctatggccgccagtcgtataaggcgccctacgccctgttcctgaaccagcggcggcacgattatgaattgcgcgtggacgcttcggtctggacgccggatttcacgatcgccggcctcgaaccgaagctgagcctcagctacctcaaggtcaccagcgacttgcccatgtatgcgcgggacagaaccgaggtcagcctgatgttggagaaacggttctga

SEQ ID NO: 30 - protein, 396 aa, A. insuavis
MRFYPWMAGVDPILRDYVHGALLRHDGRLAEAIALYRQLIARHPDLDYVRLELATMLMEDRQFAQSDAELADLRLASLEPAAQRSVMQYRQALEQQRRWNFRLGAGTVYSDNVNSANRDPMLYLPVATRRGPLWVPFAKSRDALPKSDWGLKYSGSANVERNLGGHHYYTLGADIDGTAYRVQRDYSDRALTLRGGYKWQDATRWFAATPQAGRSWMGSRRYSHNHGMSLEYGWRPTPGWQLMGAWLWLKRGYDDRAYAAYDGHLEVLSLTAIRVFSPALLAYGSVGLQREAVAAGEYSYRFPWAQLGVIKTFGRVLGARLSARYGRQSYKAPYALFLNQRRHDYELRVDASVWTPDFTIAGLEPKLSLSYLKVTSDLPMYARDRTEVSLMLEKRF

SEQ ID NO: 31 - DNA, 1332 bp, A. mimigardefordensis
atggtgtccccattgcgggatgagcccgggaacggtgctgatactgcaatgcggacaccgcgcacgttgcgactcggtgccgccgaattgtcccgttatcccgggctgcttttcaaggtgctgttacaggcgctttcggccaatcaggaagaggtcgtgctgaaattattaccgtattatcggcagcagcctgacgccgatgcccgcctgattcagtggggagaggcgatgatggcacgcagacaacggcgttatgacgagtcgatccggatgtatcgcgatacgctcgcgcgtgaaccgcagaacctgccggtgcgcatgcaactggctacgactctgtttctgaaccatgaggacgaggcggcgctggaccagttcgagcggattcgcgccatgaatttacccgcttcggcaacacatgcagtgaatcgttatattgaggctgttcaccaacgggatcaatgggacatcagcggcgggctgtcgtatatccgggatgataacgtcaacaatgctcccaggccggatacaacgctttatggttttcgtgcatgggagccggaatccgcctccggtgcacaataccggatacaactggggcgccgcttgcctctgcgaaaccaatactataaccgtgttgatatcgagaccggtggcaagcagtacttctcaaatcgacaatatagtgaatcgaatgcaactgtcagttggtcgctcggcgggcagaccggtaaccgcgatattcgtttgggcccgatgtacgaaaagaagtggtatgcaggcgggcgggcaacgagcgattctctgaaacaatattccgcctttaccgggctggcgctgcaggccagttactggttcaattcacactggcagtggcgcacgcaactgcaatgggggcgggagcgctttaatcgccaatcgtacctggatggaaccacgttgctctggtcgaacacagctttctatctgagcagtgcagcccggttctggaatgccggggtggattattatcgcaagggcgcccgggacaaggcgcatgctttccacttgtggaacgcacgggcagggtggggccaggactggccgctgggaatatcgacttatttacagatcagttatagccagcgcaaatacgaggggtaccggctgtttcttgcgcaaaggcagaaaaacaaggaaaccgttgcgcagttgtcagtctggcaccgtggtctgcactttctcggctttacgccgcgcctgacgttcagttatcaatccgtgcgtagcaatcatgccttttaccagttcgataaatcccgcgtctttgttgacgtgagccgacggttttga

SEQ ID NO: 32 - protein, 443 aa, A. mimigardefordensis
MVSPLRDEPGNGADTAMRTPRTLRLGAAELSRYPGLLFKVLLQALSANQEEVVLKLLPYYRQQPDADARLIQWGEAMMARRQRRYDESIRMYRDTLAREPQNLPVRMQLATTLFLNHEDEAALDQFERIRAMNLPASATHAVNRYIEAVHQRDQWDISGGLSYIRDDNVNNAPRPDTTLYGFRAWEPESASGAQYRIQLGRRLPLRNQYYNRVDIETGGKQYFSNRQYSESNATVSWSLGGQTGNRDIRLGPMYEKKWYAGGRATSDSLKQYSAFTGLALQASYWFNSHWQWRTQLQWGRERFNRQSYLDGTTLLWSNTAFYLSSAARFWNAGVDYYRKGARDKAHAFHLWNARAGWGQDWPLGISTYLQISYSQRKYEGYRLFLAQRQKNKETVAQLSVWHRGLHFLGFTPRLTFSYQSVRSNHAFYQFDKSRVFVDVSRRF

SEQ ID NO: 33 - DNA, 1401 bp, A. minor
atgaaaaaatacttatcccttatcctttttattcccctagttgcaaacgcagcccccgaattggaaatcaaacctgccaagccaacattgccaacacaagcggttattttttcagaaaaatcagcaaataatggggaaatcactttaacccaagagctgatcagtaaccctgaacttactcgtcaaatgttaaatcgggcgattgatagccgacaatttcatttattgcctgagctggtgcagatttatcaacaaacgcctaatcctgatttggtgctgattgattatgccaacggcattattttggcaagtcagggggattataaaacggcaatcgatctctatcgtggcattattgcgaagcatcctaattttcagcctgtgcgttttcgtttagcacaaatgttgtttgaagatcggcaaaatgaagccgcacttgcgcaatttcgtaagctacaagcggacggattaccgccacaaattgcaaatggggtggaacaatatattgctgccattcagaaacgttcgggttggtcattcgactttggtgtgaattatttgcacgaaagcaatgttaataatgcttcaagctcgccttatgttcgagtggggaatgtaccgtttaagaaaacggaagaatcattaccgcaatcagcaaatgggttgagctatcatctaaatttggctaagaattggaatgttagcggatcccattatctacatttcgagaaccaatttagcggaaaatcctattgggataatcatcaatttgacgatcagcaaaaccgttcaagtcttggctatcaatatcaaaatgctcaaagtcgtcttgcttttttgccttattatgaaatgcgttggtatggtaatcatcgctacaatcacggctatggtgttcggggagaagtagagcattggcttacatcacaatggcagctttctacggctggtgaaatgggcaaactcaaacatcggggcgaaaatcagcttgcagatagtacgacattatttggttctgctacgttactctacgcctttgatgcgaaaagttatctctatggtggtgtagatttgttgcgagatcggacgttagaacgttctttagcctcaaaacgttatacagggcgaattggttgggggcaagaatggtggggcggaatttccagccgtattcagctcagttatggcaaacgtaaatttgaccaagctcaccgcatttttaatcaaattcgtcaagatagggagttaggtttgaatgttacactttggcatcgtaacctgcatttctgggggattacgccgaaaatcagttatcaatatcagcgtgtaaattccaatttagcggatctttattcgtataaacgaaatcgagtttatttgagttttgagaaaacgttttaa

SEQ ID NO: 34 - protein, 466 aa, A. minor
MKKYLSLILFIPLVANAAPELEIKPAKPTLPTQAVIFSEKSANNGEITLTQELISNPELTRQMLNRAIDSRQFHLLPELVQIYQQTPNPDLVLIDYANGIILASQGDYKTAIDLYRGIIAKHPNFQPVRFRLAQMLFEDRQNEAALAQFRKLQADGLPPQIANGVEQYIAAIQKRSGWSFDFGVNYLHESNVNNASSSPYVRVGNVPFKKTEESLPQSANGLSYHLNLAKNWNVSGSHYLHFENQFSGKSYWDNHQFDDQQNRSSLGYQYQNAQSRLAFLPYYEMRWYGNHRYNHGYGVRGEVEHWLTSQWQLSTAGEMGKLKHRGENQLADSTTLFGSATLLYAFDAKSYLYGGVDLLRDRTLERSLASKRYTGRIGWGQEWWGGISSRIQLSYGKRKFDQAHRIFNQIRQDRELGLNVTLWHRNLHFWGITPKISYQYQRVNSNLADLYSYKRNRVYLSFEKTF

SEQ ID NO: 35 - DNA, 1437 bp, A. minor
atgaaaaaatctgcccaaatcttaccgcttgtgttgttcagtttgccaattttggcaaatccagccgataacactgagcaaaaactgcaaaatgtggctaaaccgcaagccccacaaaaatcattacctgatgcaacaaatcataccgcaagcaaagtggtggatattactgaagcggagttattacaaaattactctctcacacaacatttgctttctgaggcaatttacactcgacaagcgggctttttaagccaaattcttgcaatttatcagaaatttctacagcgagatttaattttagaaaaatttgctcaagcaaaattatatggtttaaatgagcagtattcgcctgccattgccctttatcgtgaaattctcgctgaaaagccggatttaaatgcggtacgggttgagttggcgattttactctttcgaactaaacagaataatgctgcgctagaccaatttaacaaagccaaaagtgttgaaaacctcccggcaccggtagccgatttaattgatgcctataccggcgcaatcaataagcaagatgagtggcagtttggcgcgtctgtttattatgtaaatacacacaacgtcaataacacctccgatgcgacagaaattgaaaataccggctatgttaaaggtgaaggaatgaagcctcgttcagctaaaggatttggctttaatgcagatatttcacgagattttaacttatttagtagccattatttaagttttgaaaataatgcttacggtaaaatttattggaatagccacgaagatgatgatataagcaatcgtactttattagggtatagttataaaacggttgatggtcaattccgtttactgccattttttgaaaaacgttcggtaggtaatcagtcgtatcgccgtacaaggggggcgcgagccgaatggaattattggtttaacccaaattggcaaatctcaacagcgcttgagtatggtaaacagaataattatgacagcacagctcaagacggctcaaccaaattagcctcagcgaccttgctttggttgcgcaaccctcagcaattcttctatttgggaagcgactttaatcgtgaagatgtaaaagtgaaacaatatggctcagacaccaaaagcgtacgtttaggctggggacaagaatggaatttatggggcttatccacccgcttgaacctgtcatttatgaaacgggattataaagatattgctaaattaggtggttttttatcgctcggcaaggtaagggaagataaggtttactcttcaagtttaaccttatggaaacgggattggcatttatggaatattacacctaaattacaatttagttggaaaaaatatgacagcaacctaccaacactctattcctacacggacaaaaacataaatttgttgtttgaaacgaggttttaa

SEQ ID NO: 36 - protein, 478 aa, A. minor
MKKSAQILPLVLFSLPILANPADNTEQKLQNVAKPQAPQKSLPDATNHTASKVVDITEAELLQNYSLTQHLLSEAIYTRQAGFLSQILAIYQKFLQRDLILEKFAQAKLYGLNEQYSPAIALYREILAEKPDLNAVRVELAILLFRTKQNNAALDQFNKAKSVENLPAPVADLIDAYTGAINKQDEWQFGASVYYVNTHNVNNTSDATEIENTGYVKGEGMKPRSAKGFGFNADISRDFNLFSSHYLSFENNAYGKIYWNSHEDDDISNRTLLGYSYKTVDGQFRLLPFFEKRSVGNQSYRRTRGARAEWNYWFNPNWQISTALEYGKQNNYDSTAQDGSTKLASATLLWLRNPQQFFYLGSDFNREDVKVKQYGSDTKSVRLGWGQEWNLWGLSTRLNLSFMKRDYKDIAKLGGFLSLGKVREDKVYSSSLTLWKRDWHLWNITPKLQFSWKKYDSNLPTLYSYTDKNINLLFETRF

SEQ ID NO: 37 - DNA, 1296 bp, A. minor
atgcgttctttctttttactcgccttatgttgttctaatattgtttttgcttccgtaacaacacttgaagagcaattaaagcaagctacttaccaaaataatagcggtcaaattcaatctttactttaccaatatcaacagcagcctcagcaagatttgacattaaagtcttatgcagaagctaagctagccgctttacagcataactatgacgttgctattcgtatttaccgaaaaatattgagcgaacgacctgaactaaattcaattcgaatggaattggcaaaagtactctttgccgatcgacaagatagcgcagcaagagtgcagtttgataaagtgaaaagtgtcaaaaatctaccgtcttcggcataccaacttattgaacgttatattgatgctctcaattccagaaatagttggcaatttgatgcgagcatttcctatcttaaaacggataatgtcgaaaatgtttcatcatcttcagtcattgaaaatacaggatttgtaaaaggtgcaggaatgttgccgcaaaaagcacagggttttgcctataatttgggtataaatcgtgattttaatctaataggttcacattatctcggcgtgagtaatgaaacctacggcaaaacctattgggataaccaccaatatgacgatctctttagccgtacttttatcggttatgcttacaaaaagaatgatacgactttgcgattacaacccttttatgaaaaacgctggtatggaggcaattcatttcattggtcaaatggcgcagaaatcagttacagtttttggctttcacaaaattggcaaagccaaaccgcacttgaatatgaaaaacgccgttttttcaaagataacccgcaggcagggaatattcgaacagcttcaacaacgttgatttggtatcgaaaccccgaacaaattttttatctcggagcagctttttctcagcaacgcttacaagagcgacaatacagctctgatattcagaatttacgtttaggttggttgcaagaatacgcttttggaatttcaacaaaattaaatctctcttttactcatcgtcaatttaaagatcaagcgatactgggaggtatcttgccattaagcaaaactcgccaagatcagatttattcggtttttgcacaagtgtggaaacgagattggcatttatggggtattacacctaaattaaatttggaatggcgtaagcagaaaagtaatttggatacgctttattcctataaaatgcataacgttacactcgcttttgaaaagactttctaa

SEQ ID NO: 38 - protein, 431 aa, A. minor
MRSFFLLALCCSNIVFASVTTLEEQLKQATYQNNSGQIQSLLYQYQQQPQQDLTLKSYAEAKLAALQHNYDVAIRIYRKILSERPELNSIRMELAKVLFADRQDSAARVQFDKVKSVKNLPSSAYQLIERYIDALNSRNSWQFDASISYLKTDNVENVSSSSVIENTGFVKGAGMLPQKAQGFAYNLGINRDFNLIGSHYLGVSNETYGKTYWDNHQYDDLFSRTFIGYAYKKNDTTLRLQPFYEKRWYGGNSFHWSNGAEISYSFWLSQNWQSQTALEYEKRRFFKDNPQAGNIRTASTTLIWYRNPEQIFYLGAAFSQQRLQERQYSSDIQNLRLGWLQEYAFGISTKLNLSFTHRQFKDQAILGGILPLSKTRQDQIYSVFAQVWKRDWHLWGITPKLNLEWRKQKSNLDTLYSYKMHNVTLAFEKTF

SEQ ID NO: 39 - DNA, 1386 bp, A. nasoniae
atgctcttttttgttatggaaataaaaatgactaacaggaaacgattaattataatcctatttatttcttatttttttcatataaaattaactatcgctaattcattgataataaataatacacaaatgaataaaataaataataaaaattatattaataatatttttattgctattaataaaaaagattggcatcaagttgaagattatttaaatcaattaataataagtaattatcacgataagagtttaatctattttattcagggttgtttatcatataaaaatcgagagcctcaatctgctatgcactatttatcccaggcgataataataaatcctcattttacgcgtgccaagctcgatttaagttatatttatattgaaaaccgaatttatcataaagcaaagttattattaaatgaattaatagcacagcaagatttacctgacctggttaagaaaaaaataaaatatcttctcactgtggttaataataaaaatcctttctttgccacactttcactaggttaccacctaaccgataatctgaataaatcgcctggtagcccagcagagtgcttacaaaaaaatagtgctggcgattgccgattaactcgtaaaatgccaaaaaaaattacttcatcaggcttttctttattcggtatgacccaacaggcatttatgttgcaagagcctcatgcggtttttattcgcctaatggcaaatggtcaaatctatcggcaaaacaatacctataatggatataaagccaatatttatgctggctaccattttcaatcctcataccattatttattagccggccccttattgggttatgaacaaggggaagaagatccaaatgcttatgaaatagggggaaaaattgagtggcgttatcgtcctgatatagccgctaaattagattttgtcctaaatcaccaatttaaatggaaagactattaccaaggacaacataataatggcctgaagcatgaaatttctttttccattaattatcctcttaacaatattgattggtatctctctttgggttcttctcaacatttccatcaatggcaaataaacgattatcaccgctatgatattggcggtggcgttaaatttaagtcattaccttatctagaaaccagtttttcatcactttggaatcaacatcaatttaaacactttgataaccgattaggcgctatgcggcgtgatacagaatggatctatgcaattaaattaaaactaaccataaaaattattggcttcacaccctctattaccttttttcatcgcaagaataatagcaatgtcggctggctttatcgctatcaaaaaaacgatctacaactcaattttgaacgttatttttga

SEQ ID NO: 40 - protein, 461 aa, A. nasoniae
MLFFVMEIKMTNRKRLIIILFISYFFHIKLTIANSLIINNTQMNKINNKNYINNIFIAINKKDWHQVEDYLNQLIISNYHDKSLIYFIQGCLSYKNREPQSAMHYLSQAIIINPHFTRAKLDLSYIYIENRIYHKAKLLLNELIAQQDLPDLVKKKIKYLLTVVNNKNPFFATLSLGYHLTDNLNKSPGSPAECLQKNSAGDCRLTRKMPKKITSSGFSLFGMTQQAFMLQEPHAVFIRLMANGQIYRQNNTYNGYKANIYAGYHFQSSYHYLLAGPLLGYEQGEEDPNAYEIGGKIEWRYRPDIAAKLDFVLNHQFKWKDYYQGQHNNGLKHEISFSINYPLNNIDWYLSLGSSQHFHQWQINDYHRYDIGGGVKFKSLPYLETSFSSLWNQHQFKHFDNRLGAMRRDTEWIYAIKLKLTIKIIGFTPSITFFHRKNNSNVGWLYRYQKNDLQLNFERYF

SEQ ID NO: 41 - DNA, 1491 bp, A. oleivorans
atgaaacgaacgcttttgtgctgtctgacattgttgagttgtccatttttatatgccgacgaagacacacagcttcgtctcaatcaaagcttggaccaaacgcttttacaagaacagcgccagtttcacgagcagggaaccattcgtagtaccgagcaattaccaaaacttcaaattaatggacaagaatatagtgttgagcaaaatccgaatgatcttgccaaggcgttatatttggcagtcatgcaaaaacagtggctcaaagccacggtttatttagaacattataaaaaatatgttggctacgatcgggctttaaccgactttgccgaaggggcagttgcacgttctcagggtcaactgaaattggctgaacaaaaatttcaaagcagcctaaaacaacaacctcataatttaatttgtgaacttgagttagcgcgcgtgctgtttgaacaacagaagaataaggaagcagcacgcctttttatttccattcaaaaccaactgaaacaaagtgaccctgcggtaatcccatctggggttttaacaacagtgaatacctttgttcaagcattaaaaaaacgagactcttggcaaggctcggtttcagcgggttatacctatgtcagtaatttaaatagttcgtctgaacagagcaaaacatggacactttatggcagagatagtgaaggtaatattatcccagttagggaagttactcgtggaactcctaaagctgagtcggcaacgggtttagattacgaagccagtctgattaaacgctatgcgattaaggggcatcatggcgtggctttacgtgcgctggcgtttggacagtcctataacgaccacgcggcatttaatgaatctaccatcaacattaatgcaggctacagctactttgacttaaaaaatcaaattggggtgagtccgctttttgaacataaacgttatggcaatgatggtctttacaatgcctggggtgcgcgtgccgagtggatgcattttatctctgcagataaagctttcaagcttgaagctgagagtaaagatttaaattatcagaaatataaaaccctagatggggtagaaagctcagcttttgctactttctggaagatttttccagaccagtggactgtttttggtggtttagatgtagtcgaccattcgacccaagaaaaatatatggctgcctaccagcagcaaggtatgcggttgggcttaagcaaatcttggagtacaggatttaacactactttgctgagttcttaccgttggcgtcagtttgataaatatgcggaaactttcttagcacgccgtcatgattttgaacagaactatacttttgttgtgcaaatgccgcgctttgagttttatggcatgacgcctaatttaacctaccgctataaccataataaaagtaatgtcgattggctgtattcctacgataaacacaacattagcctcaagcttgagcatcgtttttag

SEQ ID NO: 42 - protein, 496 aa, A. oleivorans
MKRTLLCCLTLLSCPFLYADEDTQLRLNQSLDQTLLQEQRQFHEQGTIRSTEQLPKLQINGQEYSVEQNPNDLAKALYLAVMQKQWLKATVYLEHYKKYVGYDRALTDFAEGAVARSQGQLKLAEQKFQSSLKQQPHNLICELELARVLFEQQKNKEAARLFISIQNQLKQSDPAVIPSGVLTTVNTFVQALKKRDSWQGSVSAGYTYVSNLNSSSEQSKTWTLYGRDSEGNIIPVREVTRGTPKAESATGLDYEASLIKRYAIKGHHGVALRALAFGQSYNDHAAFNESTININAGYSYFDLKNQIGVSPLFEHKRYGNDGLYNAWGARAEWMHFISADKAFKLEAESKDLNYQKYKTLDGVESSAFATFWKIFPDQWTVFGGLDVVDHSTQEKYMAAYQQQGMRLGLSKSWSTGFNTTLLSSYRWRQFDKYAETFLARRHDFEQNYTFVVQMPRFEFYGMTPNLTYRYNHNKSNVDWLYSYDKHNISLKLEHRF

SEQ ID NO: 43 - DNA, 1323 bp, A. oryzae
gtgaaagtcaaaaaatccgtattgaatgtctgcgccgtcctgtcgttgctgggctgcggcgccgcctggggggccgatgccaccctgggccaggccggacgcctgctggaaagcggcaagggcagcgaagcctatgtcctgctggaaagcctggagcccgaacgggccggggaaatcgaatacgacctgctgctggggctggccgccctggaggcgggccagaacacccgggcggtcttcgccctggaacgggtgctggcccaggaaccgaacaacgcccgggcccgggccgagattgcccgggcctatctggccctgggcgagaccaagaatgcccgccgcgagttcgagaatgtgcgcagcatgggcgtgccggccgaagtgggcagcaccatcgagcgtttcctggcagcagtggagcgcctggaggacgaagcccgcacccaggtccgcggctatctggagctgggtctgggcatcgacagcaacgtcaacagcggcaccagccgcggcgagtacgccattcccttcttcggcggctggatgttcccggtcggcagcggcgccaaggaaaacggtgacaccttcaccaacgtggccggcggcatcaatttccgcactcccctgcaggccggcctggccgtcaccggtggtgccgccttctcccagcgcctcaacagcaacgataccgatttcgacaacggcagctgggacgccaatctgggcctgaccaaggcggtggacaagaaccagtattcccttgccctccaggccagcaccttccgcctcaacggcgagcgctaccgggacgccatgggcttcaccggccaatggcagcacaactacgactcccgcaaccaggccagcctctacctccagtacgccagcctcacctacccgggccaggcgatccgcaacacggaccgtttcgtcgtcggcggcgcctacgcccacgccttccgcgaggggcaggtcatctacggcggcgcctacgtgggcaccgagatggagaagaacgagctggccaccttcatgggccacgacctggtgggcgtgcgcatcggcggccagatggacttggccccgcgctgggtcggctttgccaacgccaatctggaacagcgccgctaccacggcagcgaccccttcttcctcagcatccgccaggacctgcaggccaatatcaacgtgggggccaatttcagtcccagccgggaatggcacatcacgccccagttcagctatacccgcaacgactccaacctgaccctcaacgattaccaccgccaggtggtctccgttaccgtccgtcgcgatttctga

SEQ ID NO: 44 - protein, 440 aa, A. oryzae
MKVKKSVLNVCAVLSLLGCGAAWGADATLGQAGRLLESGKGSEAYVLLESLEPERAGEIEYDLLLGLAALEAGQNTRAVFALERVLAQEPNNARARAEIARAYLALGETKNARREFENVRSMGVPAEVGSTIERFLAAVERLEDEARTQVRGYLELGLGIDSNVNSGTSRGEYAIPFFGGWMFPVGSGAKENGDTFTNVAGGINFRTPLQAGLAVTGGAAFSQRLNSNDTDFDNGSWDANLGLTKAVDKNQYSLALQASTFRLNGERYRDAMGFTGQWQHNYDSRNQASLYLQYASLTYPGQAIRNTDRFVVGGAYAHAFREGQVIYGGAYVGTEMEKNELATFMGHDLVGVRIGGQMDLAPRWVGFANANLEQRRYHGSDPFFLSIRQDLQANINVGANFSPSREWHITPQFSYTRNDSNLTLNDYHRQVVSVTVRRDF

SEQ ID NO: 45 - DNA, 1521 bp, A. paragallinarum
atgttaaagcctatgaaaaaatcttttttaattttgttgagcgtagcctttcttactgctttaccaagctatgcagatgaaaatgcagaacaatctctgcaactgtggcaagactcccaacaaaaaatcaatcaacaacgaaaagaaacggcattattcacagcctcaaatcagcaagaaaatgaaatcaccttagatggacaatctttttctgtggcaaatactgaagccgatgtagggcaagcgctttatattgcggtaaatcagcaactttggcattatgcagaaaagtttttacagcaatatcgccaatttcctcaacataaaaaagaacttgtatggtttgcacaaggagcgctcgcccgtcaacgtggagagttggctaaggcggaaactgaatatcaaaaattattacaatctgaacctgattttttacggggacaattagatttagcacgcattctatttgaaaataaaaagaataaagaagccagcaaattgttttctcagcttgttcaaatgccattacccaatgaagtgagcacattattaaaggaatatttacaagttttaaaagagcgggagcaatggcacggtggattacgtgtgggttaccgctatcaaaaaaatatcaatcaatcctcagaacattatcgctgcctattattttctggcacaacttgcatcgttgaacgcgctgcccctaaagcgattaacgcaaaaggttggggatatgagcttagcctaaataaaaaatttaatttaacagggcatcacggaataaatatttatttcaatagcgaaggacaatattatccaacggctcgacaatataatgataccacatttaaaacttatattggatacgcttttcaagatgcgaaaaaagagctcgttatcgccccactttttaaatatgaatggtatgccaataagcgttattatcacgcttttggggtacatttagaatggatgcattctcttttaaaaaaacattttctcaatgtgcaatttgaacaaaaacatttgttttataatgctggttacagtgcgatagataaagcggacatttcttctttatatgccagttggtattacactcctaccaataacactacattatttactgggttcgatgggatataccgcaaagttaaagagaaaacaaatagctataaaatgctgggggcgagatttgggctttatcatcaatttaatgaaaaattagatctgaccttgcttgcttcgataaaaagcacccgttacttgcagcacaatgctattttagaaacaaaaagaaaagataatcactttatttatcaagcgattttgtcttttcccaatgtgttttataaagggataacacccaatgtaatcatcaaaagaacacataatcatagcaatgtagattggctttattcttataagcaaactgaattacaatttaatgtaagttttgtttttcaagccttactttctcgcatagaaaaagcagcgctaaaaagggattttagtgcttaa

SEQ ID NO: 46 - protein, 506 aa, A. paragallinarum
MLKPMKKSFLILLSVAFLTALPSYADENAEQSLQLWQDSQQKINQQRKETALFTASNQQENEITLDGQSFSVANTEADVGQALYIAVNQQLWHYAEKFLQQYRQFPQHKKELVWFAQGALARQRGELAKAETEYQKLLQSEPDFLRGQLDLARILFENKKNKEASKLFSQLVQMPLPNEVSTLLKEYLQVLKEREQWHGGLRVGYRYQKNINQSSEHYRCLLFSGTTCIVERAAPKAINAKGWGYELSLNKKFNLTGHHGINIYFNSEGQYYPTARQYNDTTFKTYIGYAFQDAKKELVIAPLFKYEWYANKRYYHAFGVHLEWMHSLLKKHFLNVQFEQKHLFYNAGYSAIDKADISSLYASWYYTPTNNTTLFTGFDGIYRKVKEKTNSYKMLGARFGLYHQFNEKLDLTLLASIKSTRYLQHNAILETKRKDNHFIYQAILSFPNVFYKGITPNVIIKRTHNHSNVDWLYSYKQTELQFNVSFVFQALLSRIEKAALKRDFSA

SEQ ID NO: 47 - DNA, 1566 bp, A. pittii
atgcaaaaggaatctaaatatgtaggttccttttgtttttgggcttttgcttggttgcttcaggtttattgttttatgaaacgaacgcttttgtgctgtctgacattgttgagttgtccatttttatatgccgacgaagacacacagcttcgtctcaatcaaagcttggaccaaacacttttacaagaacagcgccagtttcacgagcagggaaccattcgtagtaccgagcaattaccaaaacttcaaattaatggacaagaatatagtgttgagcaaaatccgaatgatcttgccaaggcgttatatttggcagtcatgcaaaaacagtggctcaaagccacggtttatttagaacattataaaaaatatgttggctacgatcgggctttaaccgactttgccgaaggggcagttgcacgttctcagggtcaactgaaattggctgaacaaaaatttcaaagcagcttaaaacaacaacctcataatttaatttgtgaacttgagttagcgcgcgtgctgtttgaacaacagaaaaataaggaagcagcacgcctttttatttccattcaagaccaactgaaacaaagtgatcccgctgttattccttctggggttttaacaacagtgaatacctttgtccaagcattaaaaaaacgagactcttggcaaggctcgatttcagcgggttatacctatgttagtaatttaaatagttcgtctgaacaaagcaaaacatggacgctttatggcaaagatagtgacggtaatattatcccaattgagcaagttacccgtgggacccctaaagctgaatcggcaacggggttagattacgaagccagtctgattaaacgctatgcgattaaggggcatcatggcatggctttacgtgcactggcgtttggacagtcctataacgaccacgcggcatttaatgaatctaccattaacattaatgcaggctacagctactttgacttaaaaaatcaaattggggtgagtccgctatttgaacataaacgttatggcaatgatggtctttacaatgcctggggtgcgcgtgccgagtggatgcattttatctctgcagataaagctttcaagcttgaggctgagagtaaagatttaaattatcagaaatataaaaccctagatggggtagaaagctcagcttttgctactttctggaagatttttccagaccagtggactttttttggtggtctagatgtgctcgaccattcgacccaagaaaaatacatggctgcctaccaacagcaaggtgtgcgattgggcttaagcaaatcttggagtacaggatttaataccactttgctgagttcttatcgttggcgcctgtttgataaatacgcagaaactttcttagctcgtcgtcatgattttgaacaaaactatacccttgttgtgcaaatgccgcgctttgagttttatggcatgacgcctaatttaacctatcgctataaccataataaaagcaatgttgattggctgtattcctacgataaacacaacattagtctcaagcttgagcatcgtttttag

SEQ ID NO: 48 - protein, 521 aa, A. pittii
MQKESKYVGSFCFWAFAWLLQVYCFMKRTLLCCLTLLSCPFLYADEDTQLRLNQSLDQTLLQEQRQFHEQGTIRSTEQLPKLQINGQEYSVEQNPNDLAKALYLAVMQKQWLKATVYLEHYKKYVGYDRALTDFAEGAVARSQGQLKLAEQKFQSSLKQQPHNLICELELARVLFEQQKNKEAARLFISIQDQLKQSDPAVIPSGVLTTVNTFVQALKKRDSWQGSISAGYTYVSNLNSSSEQSKTWTLYGKDSDGNIIPIEQVTRGTPKAESATGLDYEASLIKRYAIKGHHGMALRALAFGQSYNDHAAFNESTININAGYSYFDLKNQIGVSPLFEHKRYGNDGLYNAWGARAEWMHFISADKAFKLEAESKDLNYQKYKTLDGVESSAFATFWKIFPDQWTFFGGLDVLDHSTQEKYMAAYQQQGVRLGLSKSWSTGFNTTLLSSYRWRLFDKYAETFLARRHDFEQNYTLVVQMPRFEFYGMTPNLTYRYNHNKSNVDWLYSYDKHNISLKLEHRF

SEQ ID NO: 49 - DNA, 1470 bp, A. pleuropneumoniae
atgaaaatgagatttaaattatttatcactacgttcgccggcttagccgcattacccgtcattgcggaagatcttccacaaaaaatttccgatcgcttggatgatcaacgcgtgcagacggaagtcactagaccgcgcaatattgagaatccgattcgtcatgctcacgtttcacaaccgactaaagccgctaaacaaatatcaatgacaaaagaggaattgattcaacgaccggatttactgtccaacgcacttaatcttgccctcttacagggcaatgccgaaaccgtcgctttcctattcccgctttaccgacaaattccgatacaataccaagaccccggttttataaaatggtctaaagcagttattgctcgccatcacggtaattatagcgaagccattcgtcattaccgcgaaatccttgcgatgtattcggaagcgaccgccgctcgtttacagctcgccgtttcgctttttgaaaataacgaattggaagcggcggaagatcaatttgaaaaagtccgctccgataacgttcccgatgaaattaaggcgcttgtcgataaatatatcgccgctatcgcacagcgagatagatggacgttttccggcggcatgacttatctcaatgatccgaatatcaataatgcaccgaaagcaggaaccacctacggtaactggattgcgccgaaatcggaatcggcacaaggaatcggttttaattttaatatcggtaaaaaatggtcttggggtaacggtttttataacgaattgcgcttgaatacgagcggtaaatattattggaataataaaaaatataacgaagtaagcggaagaggcagtttagggttaggctatcaaaacgctcgctatgacgttactcttctaccgtttatggaacaaaccttatatgcaggcggttctaaaaataacgaatcggttaaacgtttttctaaagcgagcggcgcaacgcttgaaaccagctattggctttctcctcaatggcaatggaataccaactacgagtatgccgaagtccgctatatggatcgtaaacatctgaacggtaattatcatttcgtttcaagcggcttaacttatcttgccaatgccaaacagtattggttcggtaatctaaattacaatcgtaccgcgacacgagataaagacaatagctatgtacgtcgaggcattagcttaggttggggacaagaatggggcttaggactttcaacccgcatatcgcttagctatgcgcaaaaaaattataaagcgccgcttcctattttcggcgtgacacaacgtaacaaagaatacggcatcaacaccagtatttggcatagagccattcactattggggaatcacaccccgcttaacttatagcttcaataaagtaaaaagtagccacgtcttttacagctacgataaacaccgagtctttattgaatttagcaaacgcttctaa

SEQ ID NO: 50 - protein, 489 aa, A. pleuropneumoniae
MKMRFKLFITTFAGLAALPVIAEDLPQKISDRLDDQRVQTEVTRPRNIENPIRHAHVSQPTKAAKQISMTKEELIQRPDLLSNALNLALLQGNAETVAFLFPLYRQIPIQYQDPGFIKWSKAVIARHHGNYSEAIRHYREILAMYSEATAARLQLAVSLFENNELEAAEDQFEKVRSDNVPDEIKALVDKYIAAIAQRDRWTFSGGMTYLNDPNINNAPKAGTTYGNWIAPKSESAQGIGFNFNIGKKWSWGNGFYNELRLNTSGKYYWNNKKYNEVSGRGSLGLGYQNARYDVTLLPFMEQTLYAGGSKNNESVKRFSKASGATLETSYWLSPQWQWNTNYEYAEVRYMDRKHLNGNYHFVSSGLTYLANAKQYWFGNLNYNRTATRDKDNSYVRRGISLGWGQEWGLGLSTRISLSYAQKNYKAPLPIFGVTQRNKEYGINTSIWHRAIHYWGITPRLTYSFNKVKSSHVFYSYDKHRVFIEFSKRF

SEQ ID NO: 51 - DNA, 1416 bp, A. pleuropneumoniae
atgaagaaatttacattactgtttttttttccgacattactctttgctcaagatcccaatagtacacctagccaaatagaacatatcgctaaaccaacatcggcacccttacagcttgcagtggaacaatcgtctcgccacatttttaacgaagctgaattacgtgctaatcaggcattaaccgaaaaattactcagccaagctatctatactcgccagctcactaatatggaaaaactggtgataatttatcaagattttaaccaaattgacccaattttattgcgctatgctcaaggtaaaatcgcgctacttaaaggaaattattcacaagctattcgagagtttcgcactattcttgctaaacaacctgaactaaataccgtacgaattgaactggcaattgcattactacatgatcaacaaacgaatgcggcaagtgaacaattcgataaagctaaaagtgccgaaaacctaccttataaagtgcagcaactgattgaacagtatcagcaatatctggagaaaaaacaagcttggaagttcaatttctctgcccactatgtacgggatggtaatatcaataacacatccaaacaaactgaaattgagcataccggctatgtgaaacagcctaacctgttaccacaaactgcgcacggaattcactattcttttggactacaaagagattttaacctacttggctcgcattaccttagtttcgataatcaaacgcagggggaactttattgggataatcatgactacgatgaaatcaccaatcgcgctttgtttggctatgcttacaaaaagtcacaccaaaccacccgcgtattgccattttatgaaaaacgctggaaacatcatcaatcagaacgctggacaaacggattaaggctagaacatgcatattggctttctattcactggcaacttgctactgcattcgagtatgggaaaaaacgctatttcgaccagcacatttacaatggcagctataaacttgcttcagctaccctactctggctacgtaatccgcaacagtttttctttattggtaccgatttcaaccgagataaaaccgtattgaaacaacatagttctgataccaaaagcttacgtttcggctggcagcaggaatggcaaacacttggattatcaagccgcctgacccttgcttacaccgacagacattataaagacactgcggtgctgggtggcaaacttaatctaggtaaaattcgccatgaccgtgtgaacagcattaatcttaccctttggaaacgagattggcattggttagggcttacacccaaactgcaacttggctatgctaaacatcatagcaacttaccaagcctatatgcttacacggataaaaatgcgaatctgatcatcgaaagtcgtttttaa

SEQ ID NO: 52 - protein, 471 aa, A. pleuropneumoniae
MKKFTLLFFFPTLLFAQDPNSTPSQIEHIAKPTSAPLQLAVEQSSRHIFNEAELRANQALTEKLLSQAIYTRQLTNMEKLVIIYQDFNQIDPILLRYAQGKIALLKGNYSQAIREFRTILAKQPELNTVRIELAIALLHDQQTNAASEQFDKAKSAENLPYKVQQLIEQYQQYLEKKQAWKFNFSAHYVRDGNINNTSKQTEIEHTGYVKQPNLLPQTAHGIHYSFGLQRDFNLLGSHYLSFDNQTQGELYWDNHDYDEITNRALFGYAYKKSHQTTRVLPFYEKRWKHHQSERWTNGLRLEHAYWLSIHWQLATAFEYGKKRYFDQHIYNGSYKLASATLLWLRNPQQFFFIGTDFNRDKTVLKQHSSDTKSLRFGWQQEWQTLGLSSRLTLAYTDRHYKDTAVLGGKLNLGKIRHDRVNSINLTLWKRDWHWLGLTPKLQLGYAKHHSNLPSLYAYTDKNANLIIESRF

SEQ ID NO: 53 - DNA, 1284 bp, A. pleuropneumoniae
atgaaatcaataccttttattctgtctgtgcttcccacaacgcttttagcggaaactatttctacaccaaaaccagtcttttttgaggataaatccgatcatctaaaaccggcggaatttgcaaaaagttcaccgaatttaaccgctgataccccgatatttacaccaaccgaacaagcgaatttggatcaaaccattacctctttattgatcaataaacagtggaaagccttaaaaatcgcattagaacgttatgtaaaacagacgaattttgatccgattttatatcgttatgcaaaaggagcgatgttacgcgcggaacaagattatgacggagcgatcgagctttaccaacaaattttacagacccaaccgcagttagcttatccacgtttcgatttgggcgtaatgttgtttgaaaataaacaatatcgtgaagcgaaacagcaattaaacaaagcaagaaaatctcttgatccgcaaatgcagccgttagttgaacgttatttgcaagcaatggcagagcgtcaaaattggcaaccggatgcagaattgcaatatacacaaaccgataatgtgaataatgcgtctagtgaacgagaagttgaaatcggggtttacgattctgtggtgtacattattgggataatcaagattacagcgaaaaatcgttatacggttcttttggttatcgtaaacattctgcattacaatcttggggcattttgccgttctttgaacaaaactggcttgcttctccacgttatagcaaaaatttcggggcaaatgctgagttccgccgtcagcttaatcgccttttccaccaatttcaaccacacacaaaaacgttatgccgatgaaaatattgcacagcgttataacggttatatcaatggggtatccgcttcattaagctatactgccaatccgaattgggtgatgtttggtggtgtagaacttagcaaagatcgcactaaagataaggcagaaacctcaactcgtaagggaattaatatcggtacgctagtgcgttatggcgatgttgtgagccgagtcagtttgcgttatgtaaagcgtcatttcttggcggataacttttatttcccgaaaaaacgcattgatgacgaatacagcgtaaatgccagcctgtggcataaccaaattcaatggcaaggttttgtgccaaaattaaattatcgttatcgtaaaattgacagcaatattgccgctttttatagccgttcgagcagtgaatggtttatgacggtagaaaagaattggtag

SEQ ID NO: 54 - protein, 427 aa, A. pleuropneumoniae
MKSIPFILSVLPTTLLAETISTPKPVFFEDKSDHLKPAEFAKSSPNLTADTPIFTPTEQANLDQTITSLLINKQWKALKIALERYVKQTNFDPILYRYAKGAMLRAEQDYDGAIELYQQILQTQPQLAYPRFDLGVMLFENKQYREAKQQLNKARKSLDPQMQPLVERYLQAMAERQNWQPDAELQYTQTDNVNNASSEREVEIGVYDSMVYIIGIIKITAKNRYTVLLVIVNILHYNLGAFCRSLNKTGLLLHVIAKISGQMLSSAVSLIAFSTNFNHTQKRYADENIAQRYNGYINGVSASLSYTANPNWVMFGGVELSKDRTKDKAETSTRKGINIGTLVRYGDVVSRVSLRYVKRHFLADNFYFPKKRIDDEYSVNASLWHNQIQWQGFVPKLNYRYRKIDSNIAAFYSRSSSEWFMTVEKNW

SEQ ID NO: 55 - DNA, 1455 bp, A. rudis
atggctctcccatcactgctctttgcagcggaggatagtgatacaagattacgtttggatcagggcctattacagcaaaatatagaaaagcaaaaaccactaattgaacaacaaaaacaagatcaactaccgaccatggtcattgatggagaaatgattaaagttgaaaacaacctcaatgatcttggtcgagctttatatattgcagtgatgcaaaaacaatggtcagctgccagcatttatttgcagcgttatgaaaagttagaaggttacgatgtttcattgctgaaatttgcacaaggggctttggctcgcgtgcaaggtcatcaggacgaagctgagcaatattttaaagatgcactgctccttcaaccgaacaacgccatgattaaactcgaactggcacgactactcacagagcggcaaaaaaaccaacaagcaaagtacttgttcttagaggtaaagcaagagttacagcatagcgatgatccactgattcagagtattactaaaacaatagatgtctatttaaaaggtttaaataaacgtgatgagtggcaagggagtctgagtttaggcacacgttatgcaacgaatattaatagtgcatcagatcacaaagctattacttcccactatgtaatagatcaggacggtaacaagattttagttaaacaggagactagaggtacaccagatccaatcgatgctcaggcatttgattacgaagtcgctttaaataaacgttggtctttgcaggataaccatgggattgcatttaaagcgtttgggtatggtcgcgcttatgatgaccataaaaactttaatgaaatgactctaaatttaaatgcaggttatagctatcaagatcagcgcaatcaaattttaatcgcccctgtttttgagcatcgtcgatatcaaaacaagagtttatccaatgcgtggggagggcgtgtggagtggatgcgttttgtgggtaaagataaggcatttaagttggaagctgagtttaaggatattgataatgtcttgtattcaaaccaaagcggtgtagaaagttcaggctttgctacattttggaaagttttaccaaagcagtggactttatttggggggattgattttattgatcacaatagcgaggaggtgtatttcaccgcatatcaacagcagggtatacgtctaggtttgagtaaacagtttgcacaggattttaatgcgacactctttagttcgttccgttggcgccagtacgataagttcaacaaatttttagaggcgaagcgcgatgattttgagcaaaaccatatgctcattgtgagtgctccaaagtgggagttttatgggatgattcctagtttgatgtatcaatacaatagaaataaaagtaacgtggattggttctattcctacgataaacataatgcaagttttaaattggaatatcgtttttag

SEQ ID NO: 56 - protein, 484 aa, A. rudis
MALPSLLFAAEDSDTRLRLDQGLLQQNIEKQKPLIEQQKQDQLPTMVIDGEMIKVENNLNDLGRALYIAVMQKQWSAASIYLQRYEKLEGYDVSLLKFAQGALARVQGHQDEAEQYFKDALLLQPNNAMIKLELARLLTERQKNQQAKYLFLEVKQELQHSDDPLIQSITKTIDVYLKGLNKRDEWQGSLSLGTRYATNINSASDHKAITSHYVIDQDGNKILVKQETRGTPDPIDAQAFDYEVALNKRWSLQDNHGIAFKAFGYGRAYDDHKNFNEMTLNLNAGYSYQDQRNQILIAPVFEHRRYQNKSLSNAWGGRVEWMRFVGKDKAFKLEAEFKDIDNVLYSNQSGVESSGFATFWKVLPKQWTLFGGIDFIDHNSEEVYFTAYQQQGIRLGLSKQFAQDFNATLFSSFRWRQYDKFNKFLEAKRDDFEQNHMLIVSAPKWEFYGMIPSLMYQYNRNKSNVDWFYSYDKHNASFKLEYRF

SEQ ID NO: 57 - DNA, 1440 bp, A. segnis
atgatgaaattacccttattctttagtgtgattggtgcattggtgtcaatttcggtggctgcagaagttgctacaccgaagagcgcctcacccgaagaacgattaaagcttgctacccctcgattgcctcaacatgaaacagtggaagaatctacttcaaaagaaaatacgctttctattacgaaagaagaacttgctaaacgacctgatttaattatccgcggattgatccctgcattgttgcaaaataatgtggacgtggtggcattgctgtttccgttatatcagcagcaacaaccggcgcaacaagatccgtttttgctggcttggggggaagctatgatggcaacgcatcaaggggattatgcatcggcggtgcaacaataccgtgaattatttgcgaaacgtcctgaaattttgcagttgcgttatcaattagcccatgcgttgtttttgaataacgataatgaagcggcgaaagatcagttccaaaaactccgtgcggaggtgaatgatacttcatcacagcagatgatcgaccagtatttgattgcgattaaccaacgagatcagtggaaaattaacggtggtatcagttttttaaacgaatccaatattaataatgcgcccaaagcgggcacccgtattggggcgtggaaagcttgggagagagaacaggcgcatgggttgtcttattatgttggtgccgaaaaaaaatggtcgttgcctcatcagttttttgcaaaactggtgttagatgggcaaggcaaatattattgggataacaaaaaatataacgaatttaatgctcgaatcggtgccggtttgggttatcacacggcaaataccgaactctctttcctgtctttcactgagcgacgttggtattccggcggttcttccggcagtgatgccatgaaacaatattctaaaaattccggtgtgcgtgttgatgtgattcattggctcaataaatcatggcaaatttcgaccgcacttgaatatggtgagcaacgttatgcctcgcgtaaacatttaaatggcaataattatttgtggtcgaatacgctcttatttttgccttacagcggacaatattggtatattggtgcggattataatcgcgaaaatacgcgtgatctcgataacgcctatcaacgtaaaaatgtacgtttaggttgggtgcaagaatggccgttgggcatttccagtcgtctttctgtcgcttatgcaagacgggcttataaaggtgaagatttacttggcattcgtcaaaaaaacaacgaatatcaaactaatgtcactttatggcatcgtaacgtgtatttttggggcattacgccgaaaattacctggtcttaccaaaaaaatgacagcaatcatccattttatcgctatgataaaaatcggatttatttagaaatgagtaaaacgttttaa

SEQ ID NO: 58 - protein, 479 aa, A. segnis
MMKLPLFFSVIGALVSISVAAEVATPKSASPEERLKLATPRLPQHETVEESTSKENTLSITKEELAKRPDLIIRGLIPALLQNNVDVVALLFPLYQQQQPAQQDPFLLAWGEAMMATHQGDYASAVQQYRELFAKRPEILQLRYQLAHALFLNNDNEAAKDQFQKLRAEVNDTSSQQMIDQYLIAINQRDQWKINGGISFLNESNINNAPKAGTRIGAWKAWEREQAHGLSYYVGAEKKWSLPHQFFAKLVLDGQGKYYWDNKKYNEFNARIGAGLGYHTANTELSFLSFTERRWYSGGSSGSDAMKQYSKNSGVRVDVIHWLNKSWQISTALEYGEQRYASRKHLNGNNYLWSNTLLFLPYSGQYWYIGADYNRENTRDLDNAYQRKNVRLGWVQEWPLGISSRLSVAYARRAYKGEDLLGIRQKNNEYQTNVTLWHRNVYFWGITPKITWSYQKNDSNHPFYRYDKNRIYLEMSKTF

SEQ ID NO: 59 - DNA, 1461 bp, A. succinogenes
atgcccggtttcaacttttttattttattgtttttattttttcttcctatatccgcccacgcgacagaaattgcagtcataacagagcaaaacacgcctgaacgtaatgtaatggaagccaaacccaaatctattgcaaatgtagaaaaattacccgaaacatcgttagctatcgacaaaaaaacgggacgagggggggcacgaaatattcatacggataaaaatttagccgagtatgcgttaaataaagcgattgaacggggccatccgaatatgattgaaaaagcgttaaaaatttaccgcacttttcctaatctagatccaattttggttaaatttgccgaagccaaaatagcaaaagcgcgtcaagattattccgtggcaatccgtttattccgcgagattatcgcagagcgtgcggatctcaacccggtacgcatcgaattagcgattgttttgtttttagacaaacaggacagtgccgctaaggcgcagtttgaaaaagccttgagtgacgaaagcactccgccggatattgtccggctgattaatctttatctggaggcgctgaataaacgcgatacatggcaattcaatgtgaatgcaggatatatgcgggaagaaaatgtcaataacgtgtccgattccctttatattgaaaatacggcgtttaaaaaaggcgactccatgttgccgcaaaaagctcacggcattcaattttacgtaggattcgaacgcgatttcaatttaatgtattcccattatctccacatcgaaaatcttacctatggtaaagcctattgggacaataacgattacaccgatattaccaaccgcacatatctcggctatcgtcataaatccgccaaaaccgcctggtccgttctgccattttacgaacgtcaatggtatgccacgcaccgttataagaaagcgaccggagtacggggagaattaaatcattggttgaaccgaaactggcaaatatccaccgcgcttgaatacggcaaagaacaatatcatcgaaacgctttgctggacggtaataacaaattagcttccgctactttggtttggttgcgtacgccgcggcaatatttctatttcggcggcgattacagttttcaacgcgctcaggcacgtcactacggctatgatttaaaaaccgcacgtatcggttggggacaagaatgggaacggggtatttcgacccgtctgggctttgccgtttcaaagcgtgagtataaagccgaccatgtgctgggcaacgtattttatttcagcaaaccgcgggaagacgatatttacaacatcaacgcctccttatggaaacgcgattggcatttatggggtattacgcccaaacttcgtttcaactggaaaaaacaacgcagcaactttgacagcctttattcgtacatagatcgcagcataacagtttcggttgagaaaactttttaa

SEQ ID NO: 60 - protein, 486 aa, A. succinogenes
MPGFNFFILLFLFFLPISAHATEIAVITEQNTPERNVMEAKPKSIANVEKLPETSLAIDKKTGRGGARNIHTDKNLAEYALNKAIERGHPNMIEKALKIYRTFPNLDPILVKFAEAKIAKARQDYSVAIRLFREIIAERADLNPVRIELAIVLFLDKQDSAAKAQFEKALSDESTPPDIVRLINLYLEALNKRDTWQFNVNAGYMREENVNNVSDSLYIENTAFKKGDSMLPQKAHGIQFYVGFERDFNLMYSHYLHIENLTYGKAYWDNNDYTDITNRTYLGYRHKSAKTAWSVLPFYERQWYATHRYKKATGVRGELNHWLNRNWQISTALEYGKEQYHRNALLDGNNKLASATLVWLRTPRQYFYFGGDYSFQRAQARHYGYDLKTARIGWGQEWERGISTRLGFAVSKREYKADHVLGNVFYFSKPREDDIYNINASLWKRDWHLWGITPKLRFNWKKQRSNFDSLYSYIDRSITVSVEKTF

SEQ ID NO: 61 - DNA, 1296 bp, A. succinogenes
atgcgattttatcttttcctctgtcttttctttagttcagccgttttagcacaggatttatcaattgaatataatttaaagcaggcaatttatcggcagaacggtcaacagattcaaattttattacgggattattttcaagagaaaaataaagatccgattcttattgcttatgctcaagcaaaattagcgtttatacaaaaagattatgttacggcgattaatatttatcggaaaatcatcagttatcgtcccgatttaaattcgatgagaacggaacttgcgatcgctttgtttatggatcatcaggatgccgcagctagagtacagctggacaaagtgaggagtgctaagggcttacctgattcggcttataggttgattgaacaatacattgatgcgctcaatcaacgtaatagttggcaaattgaaggcggtttttcttatattaaaacgaacaatgtagagaatgtatctgataggattgatatagaaaataccggatttataaaaagtgaaaatatgttgccgaaaaaagctaatggattagcctataacttaagtattggtaaagatttcaatatctatcaatcccattatttgtcattaaataatgaaacgataggaaaaacgtattgggataatcatcaatatgatgatttgtctaatcgcttttttatggggtatgcatacaagaaaaatgatcagacgattcgtattcgacctttctatgataagcgttggtatggcggcaattcgtaccattggtcaaacggagttcaattcgattacggtttatggctatcatcaaattggcaaagttaccatacacttgaatatgagaaacgtaatttctttaaaaataaggaattttcgggaaacattaaaacattttctaccagcctgatctggtatcgaaaccccgaacatatatggtatatcgggacaactttttcacgagaaaatatgcaggaacgccaatatagttcggatataaaaaatatcagaatcggttggttgcaagaatattcttggggaatttctactaaattaagcatgggggcaactattcgtcagttcaaagcggaagcgattcttggtgggattttgcccttgaacaaaactcgtcaagatcatatttataccgctattgcgcagctttggaagagagattggcatttatggaatatcactccaaagttgagtttaaattggaaaaaacaaaagagtaatttagattcgctttattcttatcaggaaaagaatgctaccattgtgtttgaaaaagtattttag

SEQ ID NO: 62 - protein, 431 aa, A. succinogenes
MRFYLFLCLFFSSAVLAQDLSIEYNLKQAIYRQNGQQIQILLRDYFQEKNKDPILIAYAQAKLAFIQKDYVTAINIYRKIISYRPDLNSMRTELAIALFMDHQDAAARVQLDKVRSAKGLPDSAYRLIEQYIDALNQRNSWQIEGGFSYIKTNNVENVSDRIDIENTGFIKSENMLPKKANGLAYNLSIGKDFNIYQSHYLSLNNETIGKTYWDNHQYDDLSNRFFMGYAYKKNDQTIRIRPFYDKRWYGGNSYHWSNGVQFDYGLWLSSNWQSYHTLEYEKRNFFKNKEFSGNIKTFSTSLIWYRNPEHIWYIGTTFSRENMQERQYSSDIKNIRIGWLQEYSWGISTKLSMGATIRQFKAEAILGGILPLNKTRQDHIYTAIAQLWKRDWHLWNITPKLSLNWKKQKSNLDSLYSYQEKNATIVFEKVF

SEQ ID NO: 63 - DNA, 1464 bp, A. suis
atgaaattaaatctactcattcctacacttgccgtatctacggcatattcagcatttgctaatacgacagagcaacaaatttctgaacatttaaacgatttacgcagccaaacggaagtagcgattgaatctcgtatccaaaaacctgccagtcacccaatgcctcaacttgcgattcagcaaaaaaagcgtctaagtatgagcaaagaggaattttctaagcgcccagatttaatttcaaacgcgcttattttggcattacagcaatctaactctgattcagtcagctttctttatccattttatagtaagctgccaacacaataccaagatccaattatgcttaagtggtctgaagctattttagctcgctacagaggtaactataatagtgcaattacaaaatatcgtgaaatattagccgaacattctggtttaggcttagtccgtttacaacttgcaatggcactctttgagaataatgaattggaagcggccgaagatcaatttcaaaaaatacgatccgaaaatccaccttcccaaatcaaaggtttgattgatcagtacattaccgcaattgcaaataaagatcgttggacattctccggtggcttcacctatttaaacgatcctaacattaataatgcaccgaaatccggcacaacttacggacaatggagcgcacctaaatcagaatctgcacaagggatcggctttaatttctatgccggtaaaaaatggtcttggggaaataatttctataatgaatttcgtctaagcagtaacggaaaatattattggaataataaaaaatataatgaagtaagtgcaagaggaagccttggtttaggctatcaaaccgctcgctttaccatggcactccttccttttatggagcaaacactttatgccggtggctcaaacagcagtgaaagtttaaaacgcttttctaaagcaagtggtgcaacgttagaaacaagttattggatctcacctaaatggcaatgggaatccagctatgaatatgccgaacaacgttatatggatcgcaaacatttaaacggcaattaccatttcgtctctagcggcttaacctaccttgcgaatgcaaaacaatattggtttagcaatatcaactataatagaacagcaactcgagataaagacgatagttatgtccgtcgcggaattgtgcttggttggggacaagaatggccactcggactatcaacacgattaagtgttaactatgcacaaaaaaattacaaagcgccaatgccaatctttggtattacacaacgtaataaagaatacggtgcatcattaagtctatggcatcgtgccgtacattattgggggattacgcctcgcctgacgtatagctttaataaagtaaaaagtaatcacgtattctatagctacgataaacaccgtgcttttgtggagtttagcaaacgtttctag

SEQ ID NO: 64 - protein, 487 aa, A. suis
MKLNLLIPTLAVSTAYSAFANTTEQQISEHLNDLRSQTEVAIESRIQKPASHPMPQLAIQQKKRLSMSKEEFSKRPDLISNALILALQQSNSDSVSFLYPFYSKLPTQYQDPIMLKWSEAILARYRGNYNSAITKYREILAEHSGLGLVRLQLAMALFENNELEAAEDQFQKIRSENPPSQIKGLIDQYITAIANKDRWTFSGGFTYLNDPNINNAPKSGTTYGQWSAPKSESAQGIGFNFYAGKKWSWGNNFYNEFRLSSNGKYYWNNKKYNEVSARGSLGLGYQTARFTMALLPFMEQTLYAGGSNSSESLKRFSKASGATLETSYWISPKWQWESSYEYAEQRYMDRKHLNGNYHFVSSGLTYLANAKQYWFSNINYNRTATRDKDDSYVRRGIVLGWGQEWPLGLSTRLSVNYAQKNYKAPMPIFGITQRNKEYGASLSLWHRAVHYWGITPRLTYSFNKVKSNHVFYSYDKHRAFVEFSKRF

SEQ ID NO: 65 - DNA, 1443 bp, A. suis
atgtttaaaaaattagcgtttttatgtgctggcttattctatttgcttcaatttaatatcgcttatgcggagcaacaaattaatacacctgaaaagaatgtggaaattgctaagttacttaaggaaaccccaaaattacctgaattaaccataaattcgattgaaaatattcaacaatctgaacaagatttattaaataataaattgtttgttgagcaatttctgaataatgcaatcgaaacaggtcacctttcttcaattaaatatttattggcgatttatcgtcaattccagaattctgatcctattttaattctttttgcacaagctcagattgctaaaatccagcaacaatatgccgaggcggctaaattatatcgtgaaatattagcgattaaaccaaggcttactcctgtccgcatacaacttgcaattgtattgttcctgtctcaacaggataaggcagctaaagagcagtttgaaaaatcattgagtgaaccacagctccctgctgatattgaacaattaattcatctttatttgcaggcattggaacagcgcaatgtatggcaagtttcgttgagtgctaattatttacgtgaagacaatgtaaatcatgtttcaagcgaacgatatattgaaaataccgcttttataaaaggcgaaagtatgttgccacaaaaagcacaaggcatcagctattactttggtttagagcgcgatatcaatttatggaatgctcattatttacgtatcgataatagtttatacggtaaaaattactgggatcagcatgattatgacgatattaccaatcgcctatcgttaggctatgtacataaaggctcacagcaacgctttgcgattttgccgttttatgaacagcaatggtatggcggtcatcgatacaagcgcagtaatggtggcagaatagaatttaatcgttggttaaattcaaattggcaattttcaacggccgcagagtatgctcggaatttctattcaaatagcttaagtttaaacggtaagagtaagttagcttcattaacgatgttatggcgtgctagtcctcgtacttatttttatttaggagcggattacgctcaagaacgcactaaagttcgtcattacagctatgacttaaaaacagcccgtattggttgggggcaagaatggtatgggggaatttcttctcgtttaagtttttctgcttctaagcgagagtataaggataatctttcgctcggttcggcttttcatttcgataaacagcgtgaagaccgaatctatcatatcaatgcaaccgtttggaaacgagattggcacttatgggggattactccaaagcttaattatcactggaaaaaacaacgtagcaattttgtaagcctttattcttactcggataaaagtatcaacataatactggaaaaaactttttaa

SEQ ID NO: 66 - protein, 480 aa, A. suis
MFKKLAFLCAGLFYLLQFNIAYAEQQINTPEKNVEIAKLLKETPKLPELTINSIENIQQSEQDLLNNKLFVEQFLNNAIETGHLSSIKYLLAIYRQFQNSDPILILFAQAQIAKIQQQYAEAAKLYREILAIKPRLTPVRIQLAIVLFLSQQDKAAKEQFEKSLSEPQLPADIEQLIHLYLQALEQRNVWQVSLSANYLREDNVNHVSSERYIENTAFIKGESMLPQKAQGISYYFGLERDINLWNAHYLRIDNSLYGKNYWDQHDYDDITNRLSLGYVHKGSQQRFAILPFYEQQWYGGHRYKRSNGGRIEFNRWLNSNWQFSTAAEYARNFYSNSLSLNGKSKLASLTMLWRASPRTYFYLGADYAQERTKVRHYSYDLKTARIGWGQEWYGGISSRLSFSASKREYKDNLSLGSAFHFDKQREDRIYHINATVWKRDWHLWGITPKLNYHWKKQRSNFVSLYSYSDKSINIILEKTF

SEQ ID NO: 67 - DNA, 1416 bp, A. suis
atgaagaaatttccattactgtttttttttccgacattactctttgctcaagatcccaatagtacacctagccaaatagaacatatcgctaaaccaacatcggcacccttacagcttgcagtggaacaatcgtctcgccacatttttaacgaagctgaattacgtgctaatcaggcattaaccgaaaaattactcagccaagctatctatactcgccagctcactaatatggaaaaactggtgataatttatcaagattttaaccaaattgacccaattttattgcgctatgctcaaggtaaaatcgcgctacttaaaggaaattattcacaagctattcgagagtttcgcactattcttgctaaacaacctgaactaaataccgtacgaattgaactggcaattgcattactacatgatcaacaaacgaatgcggcaagtgaacaattcgataaagctaaaagtgccaaaaacctaccttataaagtgcagcaactgattgaacagtatcagcaatatctggagaaaaaacaagcttggaagttcaatttctctgcccactatgtacgggatggtaatatcaataacacatccaaacaaactgaaattgagcataccggctatgtgaaacagcctaacctgttaccacaaactgcgcacggaattcactattcttttggactacaaagagattttaacctacttggctcgcattaccttagtttcgataatcaaacgcagggggaactttattgggataatcatgactacgatgaaatcaccaatcgcgctttgtttggctatgcttacaaaaagtcacaccaaaccacccgcgtattgccattttatgaaaaacgctggaaacatcatcaatcagaacgctggacaaacggattaaggctagaacatgcatattggctttctattcactggcaacttgctactgcattcgagtatgggaaaaaacgctatttcgaccagcacatttacaatggcagctataaacttgcttcagctaccctactctggctacgtaatccgcaacagtttttctttattggtaccgatttcaaccgagataaaaccgtattgaaacaacatagttctgataccaaaagcttacgtttcggctggcagcaggaatggcaaacacttggattatcaagccgcctgacccttgcttacaccgacagacattataaagacactgcggtgctgggtggcaaacttaatctaggtaaaattcgccatgaccgtgtgaacagcattaatcttaccctttggaaacgagattggcattggttagggcttacacccaaactgcaacttggctatgctaaacatcatagcaacttaccaagcctatatgcttacacggataaaaatgcgaatctgatcatcgaaagtcgtttttaa

SEQ ID NO: 68 - protein, 471 aa, A. suis
MKKFPLLFFFPTLLFAQDPNSTPSQIEHIAKPTSAPLQLAVEQSSRHIFNEAELRANQALTEKLLSQAIYTRQLTNMEKLVIIYQDFNQIDPILLRYAQGKIALLKGNYSQAIREFRTILAKQPELNTVRIELAIALLHDQQTNAASEQFDKAKSAKNLPYKVQQLIEQYQQYLEKKQAWKFNFSAHYVRDGNINNTSKQTEIEHTGYVKQPNLLPQTAHGIHYSFGLQRDFNLLGSHYLSFDNQTQGELYWDNHDYDEITNRALFGYAYKKSHQTTRVLPFYEKRWKHHQSERWTNGLRLEHAYWLSIHWQLATAFEYGKKRYFDQHIYNGSYKLASATLLWLRNPQQFFFIGTDFNRDKTVLKQHSSDTKSLRFGWQQEWQTLGLSSRLTLAYTDRHYKDTAVLGGKLNLGKIRHDRVNSINLTLWKRDWHWLGLTPKLQLGYAKHHSNLPSLYAYTDKNANLIIESRF

SEQ ID NO: 69 - DNA, 1644 bp, A. xylosoxidans
gtgccgccccgcccttcgcgccgctccgagcgttccgccgcgctcatccttgcgctgttcgtcctgagcctgccgcccgcgctccaggcccaaccggccgcgccgctccccgccgccctgcccgcccccgtccggccgctggaaccggacaccccgccgctgccgcccccgcctcgtcccacgccggccatcacgcaccgccaccccgcccaacccgcgaacccgcgggttttttttaatgatacggcgaccaccgagatctacactctttccctccacgacgctcttccgatctctcgtcccacgccggccatcacgcaccgccaccccgcccaacccgcgaacccgcgggtcgaactgacggaccaggacctggcccgcaacctcaagctgaccgaacgcatcctcaaccaggccatgctgcaggaggactggagcaccttgcggcgcgtgatgcgcttttatccctggatgaccggcgtcgatccgatcctgcgcgactatgtgcatggcgcgctgctgcgccacgatggacgcctggccgaggccatcgcgctttaccgccagttgatcgcgcaacatcccgacctgggctacgtgcggctggaactggccgccatgctgatggaggaccgccaattcgcgcagtccgacgccgaactggcggacctgcgcctgggatcgctggaaccggcggcgcagcgcagcgtgatgcagtaccggcaggcgctggcccagcagcgccgctggaatttccgcctgggcgcgggcaccgtccacagcaacaacgtcaattcggccaatcgcgacccgatgctgtacctgccgatcgcgacgcggcgggggccggtgtgggcgccgttcgccaagagccgcgatgcgctgcccaaatcggattggggtttgaagtacagcggcagcgccaatgtcgaacgcaatctcggcgggcatcactactacacgctgggcgcggatatcgacggcaccgcctaccgcgtgcagcgggactacagcgaccgtaccgtgaccctgcgcggcggctacaagtggcaggatgccacgcgctggttcgccgcgacgccgcaggcgggccgaagctggatgggtggccggcgctacagccacaaccacggcatgagcctggaatacggttggcggccagcgcccgactggcaattgatgggcgcctggctatggctcaagcgcggctatgacgaccgcgcctatgccgcctacgacggccacctggacgtgctgtcgctgacggctatccgcgtgttctcgccggcgctgctggcctacggcagcgtcggcctgcagcgcgaagcggtggcggcgggcgagtacacctatcgcttcccgtgggcgcaattgggcgtggtcaagaccttcggccgggtgctcggcgcgcgcctgagcgcgcgctacggccggcaggcgtatgagtcgccctacgccctgttcctgaaccagcggcgccgcgaccgcgaattgcgcgtggacgcctcggtctggtcgccggacttcaagatcgccgggctggaaccgaagctgaacctcagttacctcaagatcgccagcaatttgcccatgtatgcgcgggaccggaccgaagtcagcctgatgttggagaagcggttctga

SEQ ID NO: 70 - protein, 547 aa, A. xylosoxidans
MPPRPSRRSERSAALILALFVLSLPPALQAQPAAPLPAALPAPVRPLEPDTPPLPPPPRPTPAITHRHPAQPANPRVFFNDTATTEIYTLSLHDALPISRPTPAITHRHPAQPANPRVELTDQDLARNLKLTERILNQAMLQEDWSTLRRVMRFYPWMTGVDPILRDYVHGALLRHDGRLAEAIALYRQLIAQHPDLGYVRLELAAMLMEDRQFAQSDAELADLRLGSLEPAAQRSVMQYRQALAQQRRWNFRLGAGTVHSNNVNSANRDPMLYLPIATRRGPVWAPFAKSRDALPKSDWGLKYSGSANVERNLGGHHYYTLGADIDGTAYRVQRDYSDRTVTLRGGYKWQDATRWFAATPQAGRSWMGGRRYSHNHGMSLEYGWRPAPDWQLMGAWLWLKRGYDDRAYAAYDGHLDVLSLTAIRVFSPALLAYGSVGLQREAVAAGEYTYRFPWAQLGVVKTFGRVLGARLSARYGRQAYESPYALFLNQRRRDRELRVDASVWSPDFKIAGLEPKLNLSYLKIASNLPMYARDRTEVSLMLEKRF

SEQ ID NO: 71 - DNA, 1512 bp, Acinetobacter sp. ADP1
ttgcttcaggtttattgttttatgaaacgaacgcttttgtgctgtctgacattgttgagttgtccatttttatatgccgacgaagacacacagcttcgtctcaatcaaagcttggaccaaacgcttttacaagaacagcgccagtttcacgagcagggaaccattcgtagtaccgagcaattaccaaaacttcaaattaatggacaagaatacagtattgaacaaaaccagaatgatcttgccaaggcgttatatttggcagtcatgcaaaaacagtggctcaaagccacggtttatttagaacattataagaaatatgttggctacgatcgggctttaaccgactttgccgaaggggcagttgcacgttctcagggtcaactgaaattggctgaacaaaaatttcaaagcagcctaaaacaacaacctcataatttaatttgtgaacttgagttagcgcgcgtgctgtttgaacaacagaaaaataaggaagcagcacgcctttttatttccattcaagatcaacttaaacaaagtgaccctgcggtaatcccgtctggagttttaaccacagtgaatacttttgttcaggcattaaaagaacgagactcttggcaaggctcggtttcagcgggttatacctatgtcagtaatttaaatagttcttctgaacagagtaaaacatggacgctttatggcaaagatagtaacggtaatattatcccaattgagcaagttacccgtgggacgcctaaagctgaatcggcaacgggtttagattacgaagccagtcttataaaacgctatgcgattaaggggcatcatggcgtggctttacgtgcgctggcgtttggacagtcctataacgaccacgcggcatttaatgaatctaccgttaacattaatgctggctacagctactttgacttaaaaaatcaaattggggtgagtccgctttttgaacataaacgttatggcaatgatggcctttacaatgcgtggggcgcgcgtgccgagtggatgcattttatctcagcagataaagccttcaagcttgaagctgagagtaaagatttaaattatcagaaatataaaaccctagatggggtagaaagttcagcttttgttactttctggaaaatcctcccaaatcagtggaccgtttttagtggtttagacgtagtcgaccattcgacccaagaaaaatatatggctgcataccagcagcaaggtgtgcggttgggcttaagcaaatcttggagcacaggatttaataccactttgctgagttcttatcgttggcgtatgtttgataaatatgcagaaactttcttagctcgtcgtcatgattttgaacagaactatacctttgtcgtgcaaatgccgcgctttgagttttatggcatgacgcctaatttaacctatcgctataaccataataaaagcaatgtcgattggctctattcctacgataaacacaacattagcctcaagcttgagcaccatttttag

SEQ ID NO: 72 - protein, 503 aa, Acinetobacter sp. ADP1
MLQVYCFMKRTLLCCLTLLSCPFLYADEDTQLRLNQSLDQTLLQEQRQFHEQGTIRSTEQLPKLQINGQEYSIEQNQNDLAKALYLAVMQKQWLKATVYLEHYKKYVGYDRALTDFAEGAVARSQGQLKLAEQKFQSSLKQQPHNLICELELARVLFEQQKNKEAARLFISIQDQLKQSDPAVIPSGVLTTVNTFVQALKERDSWQGSVSAGYTYVSNLNSSSEQSKTWTLYGKDSNGNIIPIEQVTRGTPKAESATGLDYEASLIKRYAIKGHHGVALRALAFGQSYNDHAAFNESTVNINAGYSYFDLKNQIGVSPLFEHKRYGNDGLYNAWGARAEWMHFISADKAFKLEAESKDLNYQKYKTLDGVESSAFVTFWKILPNQWTVFSGLDVVDHSTQEKYMAAYQQQGVRLGLSKSWSTGFNTTLLSSYRWRMFDKYAETFLARRHDFEQNYTFVVQMPRFEFYGMTPNLTYRYNHNKSNVDWLYSYDKHNISLKLEHHF

SEQ ID NO: 73 - DNA, 1491 bp, Acinetobacter sp. ANC 3929
atgaaaagaacattgctgtgctgtctgactctattggctgcttcatcactctatgcagatgatgatactaaacttcgcctgaatcaaagcttagatcaaaatttattacaacaacagcaccaactacaacaacaaggcacaattcgtgataccgagaaactacctagtattcttatcaatggccaaatttttgcggtagagaaaaatgaggatgatttggcaaaagctctttatttggctgtcatgcaaaaacaatggggcaatgctgcggtttatttaaagcattatcagcaatatcaagactatgatcaggctttaactgattttgccgaaggggcactggcacgtgctcaggggcagctcaaattagccgagcaaaaatttcaaagcagtctcaataaacaacccaataatctgatttgtgaactagagttagcgcgcgtgctgtttgaacagcagaagaacaaagaagcagcacgcctttttacatcaattcaaaacaaactgggacagagtgatcgtacggtgataccgccagaagtagaacaaacggttaatctgttcgtcaaagcactcgatcagcgagattcatggcaaggcagtgtcgcgattggtccatcctatgccacaaatctgaatagttcttctgaacaaagtaaaacatggacgttatatggcattgacgataagggcaatgcgactcccattcaagaaattacccgtggcagccctaaagcagcatcagcaacaggtatggactatgaagccagtttaatgaaacgcttttctctctacggcaatcatggggttgccttacgtggtttagcgtatggacagtcttatgatgatcatgccgactataacgaatccaccctaaatattaatgcaggctatagctttttcgatttaaaaaatcagatcagcattgcaccattatttgaacataaacgttatgcaaatgacggtttatacaatgcatggggtgcacgtgctgaatggatgcgatttattgcagcagacaaagcattcaagctcgaagctgaaatcaaagatctggattatcaaaaatataaaacactagatggtaaagaaagctcagcgatgttcacgttttggaagattctacctaagcaatggacattatttagtggactggatgtgcttgatcatgacacgcaagaaaaatatatggcagcctatcaacaacaaggcattcggttcgggttgagcaagtcttggaatgttgggttgaataccactttattcagttcatatcgctggcggcagtttgatcaatatgtagagacatttgcggcccgccgtcatgattttgaacaaaattataccgttgttgtgcagatgccccgatttaaattttacggcatgacaccaaatctgacttatcgttataaccacaacagtagcaatgtggattggttatattcctacgataaacacaatgtcagcttaaagcttgagcatcgtttttag

SEQ ID NO: 74 - protein, 496 aa, Acinetobacter sp. ANC 3929
MKRTLLCCLTLLAASSLYADDDTKLRLNQSLDQNLLQQQHQLQQQGTIRDTEKLPSILINGQIFAVEKNEDDLAKALYLAVMQKQWGNAAVYLKHYQQYQDYDQALTDFAEGALARAQGQLKLAEQKFQSSLNKQPNNLICELELARVLFEQQKNKEAARLFTSIQNKLGQSDRTVIPPEVEQTVNLFVKALDQRDSWQGSVAIGPSYATNLNSSSEQSKTWTLYGIDDKGNATPIQEITRGSPKAASATGMDYEASLMKRFSLYGNHGVALRGLAYGQSYDDHADYNESTLNINAGYSFFDLKNQISIAPLFEHKRYANDGLYNAWGARAEWMRFIAADKAFKLEAEIKDLDYQKYKTLDGKESSAMFTFWKILPKQWTLFSGLDVLDHDTQEKYMAAYQQQGIRFGLSKSWNVGLNTTLFSSYRWRQFDQYVETFAARRHDFEQNYTVVVQMPRFKFYGMTPNLTYRYNHNSSNVDWLYSYDKHNVSLKLEHRF

SEQ ID NO: 75 - DNA, 1491 bp, Acinetobacter sp. ANC 4105
atgaaaatagcattgctgtgttgtctgattctattggctggttcatcactctatgcagatgatgatactcaacttcgtctgaatcaaaacttggatcaaaatttattacaacaacagcatcaactacaacaacaaggggcgattcggagcacggatgagctgcccaatattgtgattaatggacaagtatttgaagttgaaaagaaccaagatgatctggcaaaagctttatatttggcggttatgcaaaagcaatggggcaatgctacggtttatttaaaacattatcagcaatatcaaggctatgatcaggctttaacggattttgccgaaggtgcgttagcacgtgctcagggacagctcaaattagcagagcaaaaatttcaaagcagtctcaataaacaaccgaataatctaatttgtgaactcgagttagcgcgcgtgctgtttgaacagcagaagaacaaagaagcagcacgcctttttacatcaattcagagcaagctaggacaaagcgatcgtgcggtgataccaccagaagtagaacaaacggttaatctgttcgtcaaagcactggatcagcgggattcatggcaaggcagtgtcgcgataggtccatcctatgccacaaatctgaatagttcttctgaacaaagcaaaacatggaccttgtatggcattgatgacaagggcaatgcgacccccattcaagaaattagacgtggcagccccaaagcagcatcagcaacgggtctggattatgaagccagtttaatcaaacgcttttctctctatggcaaccatggcgtttccttacgtggtttagcctatgggcaatcctatgatgatcaggctgactataacgaatcgaccttgaatattaatgcaggctatagttttttcgatttaaaaaatcagatcagtattgcaccactgtttgaacataaacgttatgccaatgatggtttatacaatgcatggggggcacgtgctgaatggatgcgatttattgctgcagacaaagcattcaagctggaagctgaaatcaaagatctggactatcaaaaatataaaacgctagatggtaaagaaagctcagcgatgttcacgttttggaagattctacctaagcaatggacactatttagtggactagatgtacttgatcatgacacgcaagaaaaatacatggcggcctatcaacaacaaggcatacgcttcgggttgagcaagtcttggaatgctgggttgaatactaccttgttcagttcatatcgctggcggcagtttgatcggtatgccgaaagtctagaagcccgtcgtcatgattttgaacaaaattatacattcgtggtgcagatgccccgatttaaattttatggtgtgacgccaaatctgacttatcgttataaccacaacagtagtaatgttgactggctgtattcctatgataaacacaatgtcagcttaaagcttgaacatcgtttttag

SEQ ID NO: 76 - protein, 496 aa, Acinetobacter sp. ANC 4105
MKIALLCCLILLAGSSLYADDDTQLRLNQNLDQNLLQQQHQLQQQGAIRSTDELPNIVINGQVFEVEKNQDDLAKALYLAVMQKQWGNATVYLKHYQQYQGYDQALTDFAEGALARAQGQLKLAEQKFQSSLNKQPNNLICELELARVLFEQQKNKEAARLFTSIQSKLGQSDRAVIPPEVEQTVNLFVKALDQRDSWQGSVAIGPSYATNLNSSSEQSKTWTLYGIDDKGNATPIQEIRRGSPKAASATGLDYEASLIKRFSLYGNHGVSLRGLAYGQSYDDQADYNESTLNINAGYSFFDLKNQISIAPLFEHKRYANDGLYNAWGARAEWMRFIAADKAFKLEAEIKDLDYQKYKTLDGKESSAMFTFWKILPKQWTLFSGLDVLDHDTQEKYMAAYQQQGIRFGLSKSWNAGLNTTLFSSYRWRQFDRYAESLEARRHDFEQNYTFVVQMPRFKFYGVTPNLTYRYNHNSSNVDWLYSYDKHNVSLKLEHRF

SEQ ID NO: 77 - DNA, 1464 bp, Acinetobacter sp. ATCC 27244
ttggctttatggggaaatacatcactctatgcggatgatgagactcaacttcgcctaaatcagagcctagatcagcagttattacaacaacagcgttcacttcaagcacaaggtacgattcggagcactgaaaagttacctgaactccaaatcaatggaaaagtctatgtcgtagagaagaaccaagatgatctagccaaagcgctatatctagcggttatgcaaaaacaatgggttaatgttcaaatttatttagtgcattatcaaagctatcctgagtatgatcaggctttaactgatttcgctgaaggtgcattggcacgtgctcagggacaactaaaactggctgaacaaaaattccaaagcagtttaaataaacaaccgaacaatctgatttgtgaactcgagttagcgcgtgtgctgtttgaacaacagaagaacaaagaggcagcacacctttttataacgattcaaaataaattagaacaaagtgatcacagtgtcattccaccagaagtacaaaaaacggttcagcttttcgtcaaagcgcttgctcaacgagatgcatggcaaggttctattgctataggtccgacttatgcgagcaatctaaacagttcatcagaacaaagcaaaacttggacgctgtatggcatggataaagatggcaacattatcccagctcaaattacacgaggaagtccaaaagcagtttcagcaaatggtatagattatgacgcaagcctgatcaaacgtttttccatcaaagaaaatcatggtgttgcactacgtgctctagcttatggacagtcctacgataaccaaagcaattataacgaatccaccctcaacgtaaatgcaggttatagctattacgatttaaaaaaccaaattaatttcagtccactatttgaacacaaacgttatggcaacgagagtttgtacgatgcttggggcgggcggattgaatggatgcgatttatttcaggagataaagcactcaaacttgaagcagaaattaaagattttaattatcaaacctataaaacacttaatgggcaagagcgttcggtgctggcgactttttggaaaattttaccagaacaatggacattctttggtggactcgacctccttgatcgttcgacacaagaacaatataccgcggcttaccagcaacaaggaattcgtctaggtataagtaaaccatggagtattggaattcatacaacattattaagtacttatcgttggcgacaatttgataaatacgcaaaggtttatgaagcaaggcgacatgattttgaacaaaattatacgtttgttgtgcaaatgccacgcttcaaattttatggcgtaacgccgaatttaacttatcgctataaccacaatgatagcaatgtggactggttgtacacttatgacaagcacaatgtcagcctgaaactcgaacaccgtttctag

SEQ ID NO: 78 - protein, 487 aa, Acinetobacter sp. ATCC 27244
MALWGNTSLYADDETQLRLNQSLDQQLLQQQRSLQAQGTIRSTEKLPELQINGKVYVVEKNQDDLAKALYLAVMQKQWVNVQIYLVHYQSYPEYDQALTDFAEGALARAQGQLKLAEQKFQSSLNKQPNNLICELELARVLFEQQKNKEAAHLFITIQNKLEQSDHSVIPPEVQKTVQLFVKALAQRDAWQGSIAIGPTYASNLNSSSEQSKTWTLYGMDKDGNIIPAQITRGSPKAVSANGIDYDASLIKRFSIKENHGVALRALAYGQSYDNQSNYNESTLNVNAGYSYYDLKNQINFSPLFEHKRYGNESLYDAWGGRIEWMRFISGDKALKLEAEIKDFNYQTYKTLNGQERSVLATFWKILPEQWTFFGGLDLLDRSTQEQYTAAYQQQGIRLGISKPWSIGIHTTLLSTYRWRQFDKYAKVYEARRHDFEQNYTFVVQMPRFKFYGVTPNLTYRYNHNDSNVDWLYTYDKHNVSLKLEHRF

SEQ ID NO: 79 - DNA, 1401 bp, Acinetobacter sp. CIP 102136
atgaatatcaaatatttagtaattctttcagtaacattttctagcactgcattttctcaagaattaccaccagctcaaacagtattttttgagcaagattcatttattcaacctgaattattacttaaaaaaacagtagataaagatttaaagctttctacactacctccaaactcaagtttagaagattatattaatcaagccattattcataaagactggaaagaacttgagaaactactagataaatacagaaaaactgataattacgatcacattttatacgagtatggcttaggtgctttatatcgttttcaaggaaagcaaaagaaagccatagaaatgtaccaagagattattacaaagaatccaaatttatattatccccgttttgatctagccatgatgttatttgaaaataaacaatatactgaagctaaaaatgaatttagagcagtaagaccttttcttcctactcagatccaagcattaatagatcagctattgagtactatggaagagtctcaaggatggcaaccaaacgtaaattttaattttgaaaaaacagataatgttaatcaatcatcgagtataaaagagatttctattggaaaagcaactttcatacgtgatcaggaatcactaccacaaaaggcagaaggtatcggttatacgctgaatgcatcacgtgaacaaaatatgatgagcaatcattatgtatattttaatgcaacattaaacggtattcattattgggataatacagaatttagtgagcaaaccttacgtatcgatactggttacaagtataaagatcttaagcaatccttaggcataattccatttattgggcaaaatatactaggtgatagtcgttacagtcataactatggtgcaggattagaatataaccgattattatcagatcgctggcaagtttctgctaatacatctcatatccaaaaacgatatcaggattcagatcttgcacaatattataatggtcatgctaatagtcaggctgcattgatgctgtatcaaccgaaatcgaaattactcatatatagtggcttagactggatgcaagatcgcttagcggacgaagcagaatcatctaataaaaaaggtatacgaagtggttttttatactttggggactcattgggtattagtagcaacatacgttattctaagcgtaattttttagcagataatatttggtatggtattcaacgcaaagacagtgaatatgaatttggtatagctacttggcgtaagcaatggcagtggaaaggttttactcccaagttaaattatagatatcaaaaaattgacagcaatttaccactttatgagcgtaataacggcacatggtttatcacaatagataaaaaaatttaa

SEQ ID NO: 80 - protein, 466 aa, Acinetobacter sp. CIP 102136
MNIKYLVILSVTFSSTAFSQELPPAQTVFFEQDSFIQPELLLKKTVDKDLKLSTLPPNSSLEDYINQAIIHKDWKELEKLLDKYRKTDNYDHILYEYGLGALYRFQGKQKKAIEMYQEIITKNPNLYYPRFDLAMMLFENKQYTEAKNEFRAVRPFLPTQIQALIDQLLSTMEESQGWQPNVNFNFEKTDNVNQSSSIKEISIGKATFIRDQESLPQKAEGIGYTLNASREQNMMSNHYVYFNATLNGIHYWDNTEFSEQTLRIDTGYKYKDLKQSLGIIPFIGQNILGDSRYSHNYGAGLEYNRLLSDRWQVSANTSHIQKRYQDSDLAQYYNGHANSQAALMLYQPKSKLLIYSGLDWMQDRLADEAESSNKKGIRSGFLYFGDSLGISSNIRYSKRNFLADNIWYGIQRKDSEYEFGIATWRKQWQWKGFTPKLNYRYQKIDSNLPLYERNNGTWFITIDKKI

SEQ ID NO: 81 - DNA, 1401 bp, Acinetobacter sp. CIP 102637
atgaatatcaaatatttagtcattctttcagtaacattttctagcactgcattttctcaagaattactaccagctcaaacggtattttttgagcaagattcatttattcaacctgaattattacttaaaaaaacagtagataaagatttaaatctttctacactacctccaaactcaagtttagaagattatattaatcaagcaattattcataaagactggaaagaacttgagaaactactagataaatacagaaaaactgataattacgatcacattttatacgaatatggcttaggtgctttatatcgttttcaaggaaagcaaaagaaagccatagaaatgtaccaagagattattacaaagaatccaaatttatattatccccgttttgatctagccatgatgttatttgaaaataaacaatatactgaagctaaaaatgaatttagagcagtaagaccttttcttcctactcagatccaagcattaatagatcagctattgagtactatggaagagtctcaaggatggcaaccaaacgtaaattttaattttgaaaaaacagataatgttaatcaaacatcgagtataaaagagatttctattggagaagcaactttcatacgtgatcaggaatcactaccacaaaaggcagaaggtatcggttatacgctgaatgcatcacgtgaacaaaatatgatgagcaatcattatgtatattttaatgcaacattaaacggtatttattattgggataatacagaatttagtgagcaaaccttacgtatcgatactggttacaagtataaagatcttaagcaatccttaggcataattccatttattgggcaaaatatactaggtgatagtcgttacagtcataactatggtgcaggattagaatataaccgattattatcagatcgttggcaagtctctgctaatacatctcatatccaaaaacgatatcaggattcagatcttgcacaatattataatggtcatgctaatagtcaggctgcattgatgctgtatcaaccgaaatcaaaattactcatatatagtggcttagactggatgcaagatcgcttagcggacgaagcagaatcatccaataagaaaggtatacgaagtggttttttatactttggggactcattgggtattagtagcaacatacgttattctaagcgtaattttttagcagataatatttggtatggtattcaacgcaaagacagtgaatatgaatttggtatagctacttggcgtaagcaatggcagtggaaaggttttactcccaagttaaattatagatatcaaaaaattgacagcaatttaccactttatgagcgtaataacggcacatggtttatcacaatagataaaaaaatttaa

SEQ ID NO: 82 - protein, 466 aa, Acinetobacter sp. CIP 102637
MNIKYLVILSVTFSSTAFSQELLPAQTVFFEQDSFIQPELLLKKTVDKDLNLSTLPPNSSLEDYINQAIIHKDWKELEKLLDKYRKTDNYDHILYEYGLGALYRFQGKQKKAIEMYQEIITKNPNLYYPRFDLAMMLFENKQYTEAKNEFRAVRPFLPTQIQALIDQLLSTMEESQGWQPNVNFNFEKTDNVNQTSSIKEISIGEATFIRDQESLPQKAEGIGYTLNASREQNMMSNHYVYFNATLNGIYYWDNTEFSEQTLRIDTGYKYKDLKQSLGIIPFIGQNILGDSRYSHNYGAGLEYNRLLSDRWQVSANTSHIQKRYQDSDLAQYYNGHANSQAALMLYQPKSKLLIYSGLDWMQDRLADEAESSNKKGIRSGFLYFGDSLGISSNIRYSKRNFLADNIWYGIQRKDSEYEFGIATWRKQWQWKGFTPKLNYRYQKIDSNLPLYERNNGTWFITIDKKI

SEQ ID NO: 83 - DNA, 1491 bp, Acinetobacter sp. CIP 64.2
atgaaaagaacattgctgtgctgtttgattttattggcgaattcatcactccatgcagatgatgagacacaacttcgcctgaatcaaagccttgatcagaatttattacaacaacagcaccaactacaacaacaaggtgcaattcgaagcaccgatgaactaccgaatattgtgattaacggtcaagtattcgaagttgcaaaaaatcaagatgacctcgcaaaagctttatatttggctgttatgcaaaagcaatggggtaatgctgctgtttatctaaagcattatcaacaatatgatggctatgaccaagcattaaccgattttgccgagggagcattggctcgtgcgcaaggccagctcaaattagccgaacaaaaatttcaaagcagtctcaataaacaaccgaataaccttatttgtgaacttgagttagcgcgcgtgctgtttgaacagcagaagaacaaacaagcagcacgcctttttacatcgattcaaaacaaattggggcagagtgatcgtggtgtgattccaccagaggttgaacaaacggttaatttgtttgttaaagcacttgatcagcgtgatgcatggcaaggcagtgttgcgattggcccaacctacgccacgaatctaaatagttcttctgaacaaagtaaaacttggatgttgtatggcattgaccaaaagggcaatgtgatccccattcaggagattacccgtggaagtcctaaagctgagtcggcaacgggtgtggactacgaagccagtttaatgaaacgcttttctctgtatggcaatcatggggtttccttacgtggtttggcttatggacagtcttatgacgatcatgccgactttaatgaatccaccctcaatatcaatgcaggctatagtttttttgatttaaaaaatcaaatcaccattgcaccgttatttgagcacaaacgttatgccaatgatggtttgtacaatgcttggggcgcgcgtgcagaatggatgcgctttatctccgccgataaagcactcaagcttgaagctgaaatcaaagatttaaattatcaaacatataaaactttagatggtaaagaaagttccgccatgctgaccttttggaaaatcctacctgaacaatggactctgtttggtggtgtggatgtcttagatcacgatactcaagaaaaatatatggcagcctatcagcaacaaggtgttcgtttgggtctgagcaaaccgtggaatattggattaaacacgaccttgttcagttcctatcgttggcgtcagtttgatcgttatgtggcagcatttgagacacgtcgtcaagattttgagcaaaactacacctttgtattgcaaatgcctcgtttcaaattctatggcatgacgccgaacctgacctatcgctataaccgtaataacagcaatgtggattggttgtattcctacgacaaacataatatcagcttaaagcttgagcaccgtttctag

SEQ ID NO: 84 - protein, 496 aa, Acinetobacter sp. CIP 64.2
MKRTLLCCLILLANSSLHADDETQLRLNQSLDQNLLQQQHQLQQQGAIRSTDELPNIVINGQVFEVAKNQDDLAKALYLAVMQKQWGNAAVYLKHYQQYDGYDQALTDFAEGALARAQGQLKLAEQKFQSSLNKQPNNLICELELARVLFEQQKNKQAARLFTSIQNKLGQSDRGVIPPEVEQTVNLFVKALDQRDAWQGSVAIGPTYATNLNSSSEQSKTWMLYGIDQKGNVIPIQEITRGSPKAESATGVDYEASLMKRFSLYGNHGVSLRGLAYGQSYDDHADFNESTLNINAGYSFFDLKNQITIAPLFEHKRYANDGLYNAWGARAEWMRFISADKALKLEAEIKDLNYQTYKTLDGKESSAMLTFWKILPEQWTLFGGVDVLDHDTQEKYMAAYQQQGVRLGLSKPWNIGLNTTLFSSYRWRQFDRYVAAFETRRQDFEQNYTFVLQMPRFKFYGMTPNLTYRYNRNNSNVDWLYSYDKHNISLKLEHRF

SEQ ID NO: 85 - DNA, 1491 bp, Acinetobacter sp. CIP 70.18
atgaaaagaacattgctgtgctgtttgattttattggcgagttcatcactttatgcagatgatgagacacaacttcgcctgaatcaaaacttggatcagaatttattacaacaacagcatcaattacagcaacaaggggcaattcggagcacggatgaactacccaatattgtgattaatggacaagtatttgaagttgaaaagaaccaagatgatctggcaaaagctttatatttggcggttatgcaaaagcaatggggcaatgcggcagtctatctaaagcattatcaacaatatgatggctatgaccaagctttaacagactttgccgagggtgcattggctcgcgctcaaggccagctcaagatagcagagcaaaaattccaaagtagtttaaataaacaacccaataatctgatttgcgaactcgagttagcgcgcgtgctgtttgaacagcagaagaacaaacaagcagcacgcctttttacatccattcaaagcaaattggggcagagtgatcgtggtgtgattccacctgaggtcgagcaaacagttaatctgtttgttaaggcccttgatcaacgtgacgcatggcaaggcagtgtcgcgataggtccatcctatgccacgaatctaaatagttcttctgaacaaagtaaaacttggatgttgtatggccttgaccaaaaaggcaatgtgatccccattcaggaaattacccgtggaagtcctaaagctgagtcggcaacgggtatggactatgaagccagtttaatgaaacgcttttcgttctatggcaatcatggggtttccttacgtggtttagcgtatggacagtcttatgatgatcatgctgactttaatgaatccacactgaatatcaatgcaggctatagtttttttgatttaaaaaatcaaatcacaattgcaccgctatttgagcataaacgttatgccaatgatggtttgtacaatgcttggggggcacgtgcggaatggatgcgatttatctccaccgataaagcactcaagcttgaagctgaaatcaaagatttaaattatcaaacatataaaactttagatggtaaagaaagttcagccatgctgaccttttggaaaattctacctgaacaatggacattgtttgggggcgtggatgtcttagatcatgatactcaagaaaaatacatggcagcctatcagcaacaaggtgttcgtttaggtctgagtaaaccgtggagtgttggctttaataccaccttgttcagttcctatcgttggcgtcagtttgatcgttacgtggcagcatttgagacacgtcgtcaagattttgagcaaaactacacctttgtgttgcaaatgcctcttttcaagttctatggcatgacgccgaatctgacttatcgctataaccgtaataacagtaatgtggattggttatattcctatgacaaacacaatgtcagcctaaaacttgagcaccgtttttag

SEQ ID NO: 86 - protein, 496 aa, Acinetobacter sp. CIP 70.18
MKRTLLCCLILLASSSLYADDETQLRLNQNLDQNLLQQQHQLQQQGAIRSTDELPNIVINGQVFEVEKNQDDLAKALYLAVMQKQWGNAAVYLKHYQQYDGYDQALTDFAEGALARAQGQLKIAEQKFQSSLNKQPNNLICELELARVLFEQQKNKQAARLFTSIQSKLGQSDRGVIPPEVEQTVNLFVKALDQRDAWQGSVAIGPSYATNLNSSSEQSKTWMLYGLDQKGNVIPIQEITRGSPKAESATGMDYEASLMKRFSFYGNHGVSLRGLAYGQSYDDHADFNESTLNINAGYSFFDLKNQITIAPLFEHKRYANDGLYNAWGARAEWMRFISTDKALKLEAEIKDLNYQTYKTLDGKESSAMLTFWKILPEQWTLFGGVDVLDHDTQEKYMAAYQQQGVRLGLSKPWSVGFNTTLFSSYRWRQFDRYVAAFETRRQDFEQNYTFVLQMPLFKFYGMTPNLTYRYNRNNSNVDWLYSYDKHNVSLKLEHRF

SEQ ID NO: 87 - DNA, 1488 bp, Acinetobacter sp. CIP-A165
atgaaacgaacattgctgtgttgcttggctttatggggaaatacatcactctatgcggatgatgagactcaacttcgcctaaatcagagcctagatcagcagttattacaacaacagcgttcacttcaagcacaaggtacgattcggagcactgaaaagttacctgaactccaaatcaatggaaaagtctatgtcgtagagaagaaccaagatgatctagccaaagcgctatatctagcggttatgcaaaaacaatgggttaatgttcaaatttatttagtgcattatcaaagctatcctgagtatgatcaggctttaactgatttcgctgaaggtgcattggcacgtgctcagggacaactaaaactggctgaacaaaaattccaaagcagtttaaataaacaaccgaacaatctgatttgtgaactcgagttagcgcgtgtgctgtttgaacaacagaagaacaaagaggcagcacacctttttataacgattcaaaataaattagaacaaagtgatcacagtgtcattccaccagaagtacaaaaaacggttcagcttttcgtcaaagcgcttgctcaacgagatgcatggcaaggttctattgctataggtccgacttatgcgagcaatctaaacagttcatcagaacaaagcaaaacttggacgctgtatggcatggataaagatggcaacattatcccagctcaaattacacgaggaagtccaaaagcagtttcagcaaatggtctagattatgacgcaagcctgatcaaacgtttttccatcaaagaaaatcatggtgttgcactacgtgctctagcttatggacagtcctacgataaccaaagcaattataacgaatccaccctcaacgtaaatgcaggttatagctattacgatttaaaaaaccaaattaatttcagtccactatttgaacacaaaccttatggcaacgagagtttatacgatgcttggggcgggcggattgaatggatgcgatttatttcaggcgataaagcactcaaacttgaagcagaaattaaagattttgattatcacacctataaaacacttaatgggcaagagcgttcggtactggcgactttttggaaaattttaccagaacaatggacattatttggtggactcgacctccttgatcgttcgacacaagaacaatataccgcggcttaccagcaacaaggaattcgtctaggtataagtaaaccatggaatattggaattaatacaacattattaagctcttatcgttggcgacaatttgataaatacgcaaaggtttatgaagcaagacgacatgattttgaacaaaattatacttttgttgtgcaaatgccacgcttcaaattttatggtgtaacaccgaatttaacatatcgctataaccacaatgatagcaatgtggattggttgtacacctatgacaagcacaatgtcagcctgaaactcgaacaccgtttctag

SEQ ID NO: 88 - protein, 495 aa, Acinetobacter sp. CIP-A165
MKRTLLCCLALWGNTSLYADDETQLRLNQSLDQQLLQQQRSLQAQGTIRSTEKLPELQINGKVYVVEKNQDDLAKALYLAVMQKQWVNVQIYLVHYQSYPEYDQALTDFAEGALARAQGQLKLAEQKFQSSLNKQPNNLICELELARVLFEQQKNKEAAHLFITIQNKLEQSDHSVIPPEVQKTVQLFVKALAQRDAWQGSIAIGPTYASNLNSSSEQSKTWTLYGMDKDGNIIPAQITRGSPKAVSANGLDYDASLIKRFSIKENHGVALRALAYGQSYDNQSNYNESTLNVNAGYSYYDLKNQINFSPLFEHKPYGNESLYDAWGGRIEWMRFISGDKALKLEAEIKDFDYHTYKTLNGQERSVLATFWKILPEQWTLFGGLDLLDRSTQEQYTAAYQQQGIRLGISKPWNIGINTTLLSSYRWRQFDKYAKVYEARRHDFEQNYTFVVQMPRFKFYGVTPNLTYRYNHNDSNVDWLYTYDKHNVSLKLEHRF

SEQ ID NO: 89 - DNA, 1491 bp, Acinetobacter sp. ETR1
atgaaaaaaatagtattgcttggtgccgtattgcagtgtggacaatgtgtttatgcagcggatgataccagtatcaggttaaatcaggaaattagccaacagcaatatcaaaatgataagaaactactcaaatcagaagaccctaaaaacacacaagcattaccgaatctgatcatacaaggtcaagaatatgtggttaaggatgaacccgcagaagtcgcatatgcactttacttggcagtgatgcaaaaacaatggcaagtggctttaagctatcttcgaaaatataaaaaatttccaaattatgaccaggctttgactgagttcgctgagggcgtcatggcacgaacacagggggatttaagtttagctgagagtaaacttaaacatagcctagagattcaatccaataatttaatgacccaacttgagctggctcgtgtctacaccgaacaacaaaaaaatcagcaaggtcaacagttatttcagcagattcaatctcaactggttctgtctacagatcctgctgcccaaggtataggtcaaaccgtagagatgtatctcaaagggcttaaacaacgagatgaatggcatggttcattggcttttggttcacgttatgccagtaatgttaataatgcttccgataaatacgacatcattactcgctatggtatagatccagatacagacgaagtggtgcctatagaacggatcagacgtggcacacctgatgcgatcagtgcacaaggtttggattatgaagcgaccttaactaaacgatggtcgctttctggacaacatggcattgcattgcgcggattattctatggtcaagtttatccagagcagacagattataatgaattaacttttaactttaatgcgggttatagttattacaacgaacgtaatcaagtcttgattgcacccgtatttgaacataaatactatgcccacgacccactgtatagtgcctatgggctaaggggtgagtggatgcgttttatctctaacgacaaagctgtcaagttagaagccgaattgaaagatataaattattcccaatataaaggccaagatggcgtggaatattcagtctattcaaccttttggaaaattttaccgaaaaactggacgctatttggcggactggattttgtcgaccataatacccaagaacaatattttacggcttatcaacaacaaggcgtgcgtttaggcctttccaaaaactttgactcaggttttaacgcaaatttatttagttctttccgttggcgtcaatttgataaatttactccagtgttggagtctagacgacaggattttgaacaaaattatactttgattctaagtgcaccacgctgggctttttatggtttaacacctaatctcacttatcaatataatcaaaataacagcaatgtagagtggctatattcttatgataaacacaatgtcagtttaaagctggagcatcggttttaa

SEQ ID NO: 90 - protein, 496 aa, Acinetobacter sp. ETR1
MKKIVLLGAVLQCGQCVYAADDTSIRLNQEISQQQYQNDKKLLKSEDPKNTQALPNLIIQGQEYVVKDEPAEVAYALYLAVMQKQWQVALSYLRKYKKFPNYDQALTEFAEGVMARTQGDLSLAESKLKHSLEIQSNNLMTQLELARVYTEQQKNQQGQQLFQQIQSQLVLSTDPAAQGIGQTVEMYLKGLKQRDEWHGSLAFGSRYASNVNNASDKYDIITRYGIDPDTDEVVPIERIRRGTPDAISAQGLDYEATLTKRWSLSGQHGIALRGLFYGQVYPEQTDYNELTFNFNAGYSYYNERNQVLIAPVFEHKYYAHDPLYSAYGLRGEWMRFISNDKAVKLEAELKDINYSQYKGQDGVEYSVYSTFWKILPKNWTLFGGLDFVDHNTQEQYFTAYQQQGVRLGLSKNFDSGFNANLFSSFRWRQFDKFTPVLESRRQDFEQNYTLILSAPRWAFYGLTPNLTYQYNQNNSNVEWLYSYDKHNVSLKLEHRF

SEQ ID NO: 91 - DNA, 1491 bp, Acinetobacter sp. MN12
atgaaaagaacattgctgtgctgtttgattttattggcgagttcatcactttatgcagatgatgagacacaacttcgcctgaatcaaaacttggatcagaatttattacaacaacagcatcaattacagcgacaaggggtgattcggagcacggatgaactacctaatattgtgattaatgggcaagtatttgaagttgaaaagaaccaagatgatctggcaaaagctttatatttggcggttatgcaaaagcaatggggcaatgcggcagtctatctaaagcattatcaacaatatgatggttatgaccaagctttaactgactttgccgagggtgcattggctcgtgctcaaggccagctcaagatagcagagcaaaaattccaaagtagtttaaataaacaatcgaataatctgatttgtgaactcgagttagcgcgcgtgctgtttgaacagcagaagaacaaacaagcagcacgcctttttacatccattcagagcaaattggggcagagtgatcgtggtgtgattccacctgaggtcgagcaaacagttaatctgtttgttaaggcccttgatcaacgtgacgcatggcaaggcagtgtggcgattggaccaacctatgccacgaatctaaatagttcttctgaacaaagtaaaacttggatgttgtatggccttgaccaaaaaggcaatgtgatccccattcaggaaattacccgtggaagtcctaaagctgagtcggcaacgggtatggactatgaagccagtttaatgaaacgcttttcgttctatggcaatcatggggtttccttacgtggtttagcgtatggacagtcttatgatgatcatgctgactttaatgaatccacactgaatatcaatgcaggctatagtttttttgatttaaaaaatcaaatcacaattgcaccgctatttgagcataaacgttatgccaatgatggtttgtacaatgcttggggggcacgtgcggaatggatgcgatttatctccaccgataaagcactcaagcttgaagccgaaatcaaagatttaaattatcaaacatataaaactttagatggtaaagaaagttcagccatgctgaccttttggaaaattctacctgaacaatggacattgtttgggggcgtggatgtcttagatcatgatacccaagaaaaatacatggcagcctatcagcaacaaggtgttcgtttaggtctgagtaaaccgtggagtgttggctttaataccaccttgttcagttcctatcgttggcgtcagtttgatcgttacgtggcagcatttgagacacgtcgtcaagattttgagcaaaactacacctttgtgttgcaaatgcctcttttcaagttctatggcatgacgccgaatctgacttatcgctataaccgtaataacagtaatgtggattggttatattcctatgacaaacacaatgtcagcctaaaacttgagcaccgtttttag

SEQ ID NO: 92 - protein, 496 aa, Acinetobacter sp. MN12
MKRTLLCCLILLASSSLYADDETQLRLNQNLDQNLLQQQHQLQRQGVIRSTDELPNIVINGQVFEVEKNQDDLAKALYLAVMQKQWGNAAVYLKHYQQYDGYDQALTDFAEGALARAQGQLKIAEQKFQSSLNKQSNNLICELELARVLFEQQKNKQAARLFTSIQSKLGQSDRGVIPPEVEQTVNLFVKALDQRDAWQGSVAIGPTYATNLNSSSEQSKTWMLYGLDQKGNVIPIQEITRGSPKAESATGMDYEASLMKRFSFYGNHGVSLRGLAYGQSYDDHADFNESTLNINAGYSFFDLKNQITIAPLFEHKRYANDGLYNAWGARAEWMRFISTDKALKLEAEIKDLNYQTYKTLDGKESSAMLTFWKILPEQWTLFGGVDVLDHDTQEKYMAAYQQQGVRLGLSKPWSVGFNTTLFSSYRWRQFDRYVAAFETRRQDFEQNYTFVLQMPLFKFYGMTPNLTYRYNRNNSNVDWLYSYDKHNVSLKLEHRF

SEQ ID NO: 93 - DNA, 1491 bp, Acinetobacter sp. NIPH 1847
atgaacaaaacattgctgtgctgtgtgattttactggctgcttcatcactctatgccgatgatgagacacaactccgccttaatcagagtctggatcagaatctgttccagcaacagcatcaattacaacaacaaggcaccattcgtgacaccgagaaactacccagcatccgtattaatggccaaatttacgcggtagagcagaatccggatgatctggccaaagcgctatatctggcggttatgcaaaagcaatggggcaatgctgcgatttacttaaaacactatcagcagtatcaaggctatgatcaggctttaaccgattttgccgaagcggctttggcgcgcgctcagggaaagctcaaattagccgaacaaaaatttcaaagtagtcttaatcaacaaccgaataatctgatttgtgaactcgagttagcgcgcgtgctgtttgaacagcagaagaataaacaagcagcacgcctttttacatcgattcaggacaagctagggcagagcaatggggcaatgatcccaccagaagtgcaacaaacggttgatctgttcgtcaaagcacttgatcagcgggattcgtggcaaggcagtgtcgcaattggcccatcctatgccaccaatctgaatagctcttctgaacaaagcaaaacatggaccttgtatggcattgatgacaagtgcaaggcgactccaattcaggaaattacccgtggcagtcccaaagcagcatcagcaacaggggttgactatgaggccagtctaatcaagcgcttttcgctttcgggcaatcatggcatttccttacgcggtttagcatttgggcaatcctatgctgatcatgcgctctataacgaatccaccctgaatatcaatgcaggctatagtttttttgatttaaaaaatcaaatcaccattgcaccgctatttgaacataaacgttatgccaatgatggtttatacaatgcatggggggcacgtactgaatggatgcgatttctagcaccagacaaagccttcaagcttgaagctgaaatcaaagatctgggctatcaaaagtataaaaacctagatggtaaagaaagctcggcaatgtttacattctggaaaattctaccgcagcaatggacactttttagcggactggatgtactggatcatgacacccaggaaaaatatatggcggcttatcagcaacaaggcatccgtctaggactgagcaaatcctggaaagcaggtttaaataccacgctattaacctcataccgctggcggcagtttgaccgctacgtcgagacctttgctgcacgtcgccatgattttgaacagaactataccctggttgtacaaatgccacggtttaagttttatggtatgacgccgaatttgacctatcgctacaaccataatgacagtaatgtcgactggctctattcctacgataaacacaatatcagcttaaagctggaacatcgtttttag

SEQ ID NO: 94 - protein, 496 aa, Acinetobacter sp. NIPH 1847
MNKTLLCCVILLAASSLYADDETQLRLNQSLDQNLFQQQHQLQQQGTIRDTEKLPSIRINGQIYAVEQNPDDLAKALYLAVMQKQWGNAAIYLKHYQQYQGYDQALTDFAEAALARAQGKLKLAEQKFQSSLNQQPNNLICELELARVLFEQQKNKQAARLFTSIQDKLGQSNGAMIPPEVQQTVDLFVKALDQRDSWQGSVAIGPSYATNLNSSSEQSKTWTLYGIDDKCKATPIQEITRGSPKAASATGVDYEASLIKRFSLSGNHGISLRGLAFGQSYADHALYNESTLNINAGYSFFDLKNQITIAPLFEHKRYANDGLYNAWGARTEWMRFLAPDKAFKLEAEIKDLGYQKYKNLDGKESSAMFTFWKILPQQWTLFSGLDVLDHDTQEKYMAAYQQQGIRLGLSKSWKAGLNTTLLTSYRWRQFDRYVETFAARRHDFEQNYTLVVQMPRFKFYGMTPNLTYRYNHNDSNVDWLYSYDKHNISLKLEHRF

SEQ ID NO: 95 - DNA, 1491 bp, Acinetobacter sp. NIPH 1859
atgaaaagaacattactgtgctgtttgattttattggcgaattcatcactctatgcagatgatgagacacaacttcgcctgaatcaaagccttgatcagaatttattacaacaacagcaccaactacaacaacaaggtgcaattcgaagcaccgatgaactaccgaatattgtgattaacggtcaagtattcgaagttgcaaaaaatcaagatgacctcgcaaaagctttatatttggctgttatgcaaaagcaatggggtaatgctgctgtttatctaaagcattatcaacaatatgatggctatgaccaagcattaaccgattttgccgagggagcattggctcgtgcgcaaggccagctcaaattagccgaacaaaaatttcaaagcagtctcaataaacaaccgaataaccttatttgtgaacttgagttagcgcgcgtgctgtttgaacagcagaagaacaaacaagcagcacgcctttttacatcgattcaaaacaaattggggcagagtgatcgtggtgtgattccaccagaggttgaacaaacggttaatttgtttgttaaagcacttgatcagcgtgatgcatggcaaggcagtgttgcgattggcccaacctacgccacgaatctaaatagttcttctgaacaaagtaaaacttggatgttgtatggcattgaccaaaagggcaatgtgatccccattcaggagattacccgtggaagtcctaaagctgagtcggcaacgggtgtggactacgaagccagtttaatgaaacgcttttctctgtatggcaatcatggggtttccttacgtggtttggcttatggacagtcttatgacgatcatgccgactttaatgaatccaccctcaatatcaatgcaggctatagtttttttgatttaaaaaatcaaatcaccattgcaccgttatttgagcacaaacgctatgccaatgatggtttgtacaatgcttggggcgcgcgtgcagaatggatgcgctttatctccgccgataaagcactcaagcttgaagctgaaatcaaagatttaaattatcaaacatataaaactttagatggtaaagaaagttccgccatgctgaccttttggaaaatcctacctgaacaatggactctgtttggtggtgtggatgtcttagatcacgatactcaagaaaaatatatggcagcctatcagcaacaaggtgttcgtttgggtctgagcaaaccgtggaatattggattaaacaccaccttgttcagttcctatcgttggcgtcagtttgatcgttacgtggcagcatttgagacacgtcgtcaagattttgagcaaaactatacttttgtgttgcaaatgcctcgtttcaaattctatggcatgacgccgaacctgacctatcgctataaccgtaataacagcaatgtggattggttgtattcctacgacaaacataatatcagcttaaagcttgagcaccgtttctag

SEQ ID NO: 96 - protein, 496 aa, Acinetobacter sp. NIPH 1859
MKRTLLCCLILLANSSLYADDETQLRLNQSLDQNLLQQQHQLQQQGAIRSTDELPNIVINGQVFEVAKNQDDLAKALYLAVMQKQWGNAAVYLKHYQQYDGYDQALTDFAEGALARAQGQLKLAEQKFQSSLNKQPNNLICELELARVLFEQQKNKQAARLFTSIQNKLGQSDRGVIPPEVEQTVNLFVKALDQRDAWQGSVAIGPTYATNLNSSSEQSKTWMLYGIDQKGNVIPIQEITRGSPKAESATGVDYEASLMKRFSLYGNHGVSLRGLAYGQSYDDHADFNESTLNINAGYSFFDLKNQITIAPLFEHKRYANDGLYNAWGARAEWMRFISADKALKLEAEIKDLNYQTYKTLDGKESSAMLTFWKILPEQWTLFGGVDVLDHDTQEKYMAAYQQQGVRLGLSKPWNIGLNTTLFSSYRWRQFDRYVAAFETRRQDFEQNYTFVLQMPRFKFYGMTPNLTYRYNRNNSNVDWLYSYDKHNISLKLEHRF

SEQ ID NO: 97 - DNA, 1491 bp, Acinetobacter sp. NIPH 1867
atgaaaagaacattgctgtgttgtctgattttattggctggttcatcactctatgcagatgatgatactcaacttcgtctgaatcaaaacttagatcaaaatttattacaacagcagcaccaactacaacaacaaggggcgattcgaagcaccgacgaactaccgaatattgtgattaatggtcaagtatttgaagttgaaaaaaatcaagatgatctggcaaaggccttatatttggcggttatgcaaaaacaatggggcaatgctgcggtttatttaaaacattatcagcaatatcaaggctacgatcaggctttaacggattttgccgaaggtgcgttagcacgtgctcagggacagctcaaattagcagagcaaaaatttcaaagcagtctcaataaacaaccgaataatctgatttgtgaactagagttagcgcgcgtgctgtttgaacagcagaagaacaaacaagcagcacgcctttttatatcaattcagaacaagctaggacaaagcgatcgtgcggtgataccgccagaagtagaaaaaacagttaatctgttcgtcaaagcactggatcagcgggactcatggcaaggcagtgtcgcgataggtccatcctatgccacaaatctgaatagttcttctgaacaaagcaaaacatggaccttgtatggcattgatgacaagggcaatgcgacccccattcaagaaattagacgtggcagcccaaaagcagcatcagcaacgggtatggattatgaagccagtttaatcaaacgcttttcgctctatggcaaccatggcgtttccttacgtggtttagcctatgggcaatcctatgatgattatgctgactataatgaatccaccctaaatattaatgcaggctatagttttttcgatttaaaaaatcagatcagtattgcaccactgtttgaacataaacgttatgccaatgatggtttatacaatgcatggggtgcacgtgctgaatggatgcgatttattgctgcagacaaagcattcaagctggaagctgaaatcaaagatctagactatcaaaaatataaaacgctagatggtaaagaaagctcggcgatgttcaccttttggaagattctacccaaacaatggacattatttagtggactagatgtacttgatcatgacacgcaagaaaagtacatggcggcctatcaacaacaaggtgtccgtttaggattgagcaagtcttggaatgtcggattgaatacaacgttattcagttcatatcgctggcgccagtttgatcggtatgccgaaagtctagaagcccgtcgtcatgattttgaacaaaattatacattcgtggtgcaaatgcctcgatttaaattttatggtgtgacgccaaatctgacttatcgttataaccacaacagtagcaatgttgactggctgtattcctatgataaacacaatgtcagcttaaagcttgaacatcgtttttag

SEQ ID NO: 98 - protein, 496 aa, Acinetobacter sp. NIPH 1867
MKRTLLCCLILLAGSSLYADDDTQLRLNQNLDQNLLQQQHQLQQQGAIRSTDELPNIVINGQVFEVEKNQDDLAKALYLAVMQKQWGNAAVYLKHYQQYQGYDQALTDFAEGALARAQGQLKLAEQKFQSSLNKQPNNLICELELARVLFEQQKNKQAARLFISIQNKLGQSDRAVIPPEVEKTVNLFVKALDQRDSWQGSVAIGPSYATNLNSSSEQSKTWTLYGIDDKGNATPIQEIRRGSPKAASATGMDYEASLIKRFSLYGNHGVSLRGLAYGQSYDDYADYNESTLNINAGYSFFDLKNQISIAPLFEHKRYANDGLYNAWGARAEWMRFIAADKAFKLEAEIKDLDYQKYKTLDGKESSAMFTFWKILPKQWTLFSGLDVLDHDTQEKYMAAYQQQGVRLGLSKSWNVGLNTTLFSSYRWRQFDRYAESLEARRHDFEQNYTFVVQMPRFKFYGVTPNLTYRYNHNSSNVDWLYSYDKHNVSLKLEHRF

SEQ ID NO: 99 - DNA, 1491 bp, Acinetobacter sp. NIPH 2100
atgaaaagaacattgctgtgctgtctgactctattggctacttcatcactctatgcagatgatgatactcaacttcgcctgaatcaaagcttggatcaaaatttattacaacaacagcaccaactacaacaacaaggcacaattcgtgataccgagaaactacctagtattcttatcaatggccaaatttttgcggtagagaaaaatcaagatgatttggcaaaagccctctatttggctgtcatgcaaaaacaatggggcaatgctgcggtttatttaaagcattatcagcaatatcaagactatgatcaggctttaactgattttgccgaaggggcattggcacgtgctcagggtcagctcaaattagccgagcaaaaatttcaaagcagtctcaataaacaaccgaataatcttatttgtgaactagagttagcgcgcgtgctgtttgaacagcagaagaacaaagaagcagcacgcctttttacatcaattcaaaacaaactgggacagagtgatcgtgcggtgataccgccagaagtagaacaaacggttaatctgttcgtcaaagcactcgatcagcgggattcatggcaaggcagtgtcgcgattggtccatcctatgccacaaatctgaatagttcttctgaacaaagtaaaacatggacgttatatggcattgacgataagggcaatgcgactcccattcaagaaattacccgtggcagccctaaagcagcatcagcaacaggtatggactatgaagccagtttaatgaaacgcttttctctctacggcaatcatggggtttccttacgtgggctagcttatggacagtcctatgatgatcatgccgactataacgaatccacactaaatattaatgcaggctatagctttctcgatttaaaaaatcagatcagcattgcaccattgtttgaacataaacgttatgcaaatgacggtttatacaatgcatggggtgcacgtgctgaatggatgcgatttattgccgcagacaaagcattcaagctcgaagctgaaatcaaagatctagattatcaaaaatataagacattagatggtaaagaaagctcagcgatgttcacgttttggaagattctacctaagcaatggacattatttagtggactggatgtgcttgatcatgacactcaagaaaagtatatggcagcctatcagcagcaaggcattcgtttaggcttaagtaagtcttggaatgtcgggttgaataccaccttattcagttcatatcgctggcggcagtttgatcaatatgtcgagacatttgcggcccgccgtcatgattttgaacaaaattatacctttgttgtgcagatgccccgatttaaattttacggcatgacaccaaatctgacttatcgttataaccacaacagtagcaatgtggattggttatattcctacgataaacacaatgtcagcttgaagcttgagcatcgtttttaa

SEQ ID NO: 100 - protein, 496 aa, Acinetobacter sp. NIPH 2100
MKRTLLCCLTLLATSSLYADDDTQLRLNQSLDQNLLQQQHQLQQQGTIRDTEKLPSILINGQIFAVEKNQDDLAKALYLAVMQKQWGNAAVYLKHYQQYQDYDQALTDFAEGALARAQGQLKLAEQKFQSSLNKQPNNLICELELARVLFEQQKNKEAARLFTSIQNKLGQSDRAVIPPEVEQTVNLFVKALDQRDSWQGSVAIGPSYATNLNSSSEQSKTWTLYGIDDKGNATPIQEITRGSPKAASATGMDYEASLMKRFSLYGNHGVSLRGLAYGQSYDDHADYNESTLNINAGYSFLDLKNQISIAPLFEHKRYANDGLYNAWGARAEWMRFIAADKAFKLEAEIKDLDYQKYKTLDGKESSAMFTFWKILPKQWTLFSGLDVLDHDTQEKYMAAYQQQGIRLGLSKSWNVGLNTTLFSSYRWRQFDQYVETFAARRHDFEQNYTFVVQMPRFKFYGMTPNLTYRYNHNSSNVDWLYSYDKHNVSLKLEHRF

SEQ ID NO: 101 - DNA, 1491 bp, Acinetobacter sp. NIPH 2168
atgaaaagaacattgctgtgctgtctgactctattggctgcttcatcactctatgcagatgatgatactcaacttcgcctgaatcaaagtttggatcagaatttattacaacagcaacatcaactacaacaacaaggcacaattcgtgataccgagaaactccccagtatccgtatcaatggtcaaatttatgcagtagaaaaaaatcaggatgatttggccaaagccctctatctggctgtcatgcaaaaacagtggggcaatgctacggtttatttaaagcattatcagcaatatgaaggctatgatcaggctttaactgattttgctgaaggggcattggcacgtgcccaagggcagctcaaattagccgagcaaaaatttcaaagcagtctcaataaacaacccaataatcttatttgtgaactagagttagcgcgcgtgctgtttgaacagcaaaagaacaaagaagcagcacgcctttttacatcaattcaaaacaaattgggacagagtgatcgggcggtgataccgcctgaagtagaacaaacggttaatctgttcgtcaaagcgctcgatcagcgtgattcatggcaaggcagtgtcgcgattggtccatcctatgccacaaatctgaatagttcttctgaacaaagtaaaacttggacgttgtatggtattgacgataagggcaatgcgactcccatccaagaaattacccgtggcagtcccaaagcagcatcagcaacgggtatggactatgaagccagtttaatgaaacgcttttctctctacggcaatcatgggatttccttacgtgggttagcatatggacagtcttatgatgatcatgctgactataacgaatccaccctgaacattaatgcaggttatagttttttcgatttaaaaaatcagatcagtattgcaccgctgtttgaacataaacgttatgcaaataatggtttatacaatgcatggggtgcacgtgctgaatggatgcgatttattgccgcagacaaagcattcaagcttgaagctgaaatcaaggatctggattatcaaaaatataaaacattagatggtaaagaaagctcggcgatgttcaccttttggaagattctacccaaacaatggacattatttagtggactagatgtactggatcatgacacccaagaaaagtacatggcggcctatcaacaacaaggtgtccgtttagggctgagtaaatcctggaatgttgggttgaataccactttatttagttcatatcgctggcggcagtttgatcgatatgccgaaagtctacaagcccgtcgtcatgattttgaacaaaattatacctttgttttgcagatgccccgatttaaattttacggcatgacgccaaatctgacttatcgttataaccataacaatagcaatgtggattggttgtattcctatgataaacacaatgtcagcttgaagcttgagcatcgtttttag

SEQ ID NO: 102 - protein, 496 aa, Acinetobacter sp. NIPH 2168
MKRTLLCCLTLLAASSLYADDDTQLRLNQSLDQNLLQQQHQLQQQGTIRDTEKLPSIRINGQIYAVEKNQDDLAKALYLAVMQKQWGNATVYLKHYQQYEGYDQALTDFAEGALARAQGQLKLAEQKFQSSLNKQPNNLICELELARVLFEQQKNKEAARLFTSIQNKLGQSDRAVIPPEVEQTVNLFVKALDQRDSWQGSVAIGPSYATNLNSSSEQSKTWTLYGIDDKGNATPIQEITRGSPKAASATGMDYEASLMKRFSLYGNHGISLRGLAYGQSYDDHADYNESTLNINAGYSFFDLKNQISIAPLFEHKRYANNGLYNAWGARAEWMRFIAADKAFKLEAEIKDLDYQKYKTLDGKESSAMFTFWKILPKQWTLFSGLDVLDHDTQEKYMAAYQQQGVRLGLSKSWNVGLNTTLFSSYRWRQFDRYAESLQARRHDFEQNYTFVLQMPRFKFYGMTPNLTYRYNHNNSNVDWLYSYDKHNVSLKLEHRF

SEQ ID NO: 103 - DNA, 1401 bp, Acinetobacter sp. NIPH 713
atgaatatcaaatatgtagtaattctttcagtaacattctctagcactgcattttctcaagaattaccaccagctcaaacagtattttttgagcaagattcatttattcaacctgaattattacttaaaaaaacagtagataaagatttaaagctttctacactacctccaaactcaagtttagaagattatattaatcaagccattattgataaagactggaaagaacttgagaaactactagataaatacagaaaaactgataattacgatcacattttatacgagtatggcttaggtgctttatatcgttttcaaggaaagcaaaagaaagccatagaaatgtacaaagcgattattacaaagaatccaaatttatattatccccgttttgatctagccatgatgttatttgaaaataaacaatatactgaagctaaaaatgaatttagagcaataagaccttttcttcctactcagatccaagcattaatagatcagctattgagtactatggaagagtctcaaggatggcaaccaaacgtaaattttaattttgaaaaaacagataatgttaatcaatcatcgagtataaaagagatttctattggagaagcaactttcatacgtgatcaggaatcactaccacaaaaggcagaaggtatcggttatacgctgaatgcatcacgtgaacaaaatatgatgagcaatcattatgtatattttaatgcagcattaaacggtattcattattgggataatacagaatttagtgagcaaaccttacgtatcgatactggttacaagtataaagatcttaagcaatccttaggcataattccatttattgggcaaaatatactaggtgatagtcgttacagtcataactatggtgcaggattagaatataaccgattattatcagatcgttggcaagtttctgctaatacatctcttatccaaaaacgatatcaggattcagatcttgcacaatattataatggtcatgctaatagtcaggctgcattgatgctgtatcaaccgaaatcaaaattactcatatatagtggcttagactggatgcaagatcgcttagcggacgaagcagaatcatccaataagaaaggtatacgaagtggttttttatactttggggactcattgggtattagtagcaacatacgttattctaagcgtaattttttagcagataatatttggtatggtattcaacgcaaagacagtgaatatgaatttggtatagctacttggcgtaagcaatggcagtggaaaggttttactcccaagttaaattatagatatcaaaaaattgacagcaatttaccactttatgagcgtaataacggcacatggtttatcacaatagataaaaaaatttaa

SEQ ID NO: 104 - protein, 466 aa, Acinetobacter sp. NIPH 713
MNIKYVVILSVTFSSTAFSQELPPAQTVFFEQDSFIQPELLLKKTVDKDLKLSTLPPNSSLEDYINQAIIDKDWKELEKLLDKYRKTDNYDHILYEYGLGALYRFQGKQKKAIEMYKAIITKNPNLYYPRFDLAMMLFENKQYTEAKNEFRAIRPFLPTQIQALIDQLLSTMEESQGWQPNVNFNFEKTDNVNQSSSIKEISIGEATFIRDQESLPQKAEGIGYTLNASREQNMMSNHYVYFNAALNGIHYWDNTEFSEQTLRIDTGYKYKDLKQSLGIIPFIGQNILGDSRYSHNYGAGLEYNRLLSDRWQVSANTSLIQKRYQDSDLAQYYNGHANSQAALMLYQPKSKLLIYSGLDWMQDRLADEAESSNKKGIRSGFLYFGDSLGISSNIRYSKRNFLADNIWYGIQRKDSEYEFGIATWRKQWQWKGFTPKLNYRYQKIDSNLPLYERNNGTWFITIDKKI

SEQ ID NO: 105 - DNA, 1491 bp, Acinetobacter sp. NIPH 809
atgaaaagaacattgctgtgctgtttgattttattggcgagttcatcactttatgcagatgatgagacacaacttcgcctgaatcaaaacttggatcagaatttattacaacaacagcatcaattacaacaacaaggggcaattcggagcacagacgaattacccaatattgtaattaatgggcaagtatttgaagttgaaaagaaccaagatgatctggcaaaagctttatatttggcagtcatgcaaaagcaatggggcaatgcggcagtctatctaaagcattatcaacaatatgatggctatgacaaagctttaacagactttgccgagggtgcattggctcgtgctcaaggccagctcaagatagcagagcataaattccaaagtagtttaaataaacaacccaataatctgatttgtgaactcgagttagcgcgcgtgctgtttgaacagcagaagaacaaacaagcagcacgcctttttacatccattcagagcaaattggggcaaagtgatcgtggggtaattccgcctgaggtcgaacaaacggttaagctgttcgttaaggcactggagcagcgggattcatggcaaggcagtgttgcgattggaccaacctatgccacgaatctaaatagttcttctgaacaaagtaaaacttggatgttgtatggccttgaccaaaaaggcaatgtgatccccattcaggagattacccgtggaagtcctaaagctgagtcggcaacgggtatggactatgaagccagtttaatgaaacgcttttcgctctatggcaatcatggggtttccttacgtggtttagcgtatggacaatcttatgatgatcatgctgactttaatgaatccacactgaatatcaatgcaggttatagtttttttgatttaaaaaatcaaatcacaattgcaccgctatttgagcataaacgttatgccaatgatggtttgtacaatgcctggggggcacgtgcggaatggatgcgatttatctccgccgataaagcactcaagcttgaagctgaaatcaaagatttaaattatcaaacatataaaactttagatggcaaagaaagttcagccatgctgaccttttggaaaatcttacctgaacaatggaccttgtttggtggtgcggatgtcttagatcatgatacccaagaaaaatacatggcagcctatcagcagcaaggtgttcgtttgggtctgagtaaaccgtggagtgctggctttaataccactttattcagtttgtatcgctggcgccagtttgatcgttacgtggcggcatttcaaacacgtcgtcaagattttgagcaaaactacacctttgtgttgcaaatgcctcgtttcaaattctatggaatgacgccgaatttgacctatcgctataaccgtaataatagcaatgtggattggttatattcctatgacaaacacaatgtcagcctaaaacttgagcaccgtttttag

SEQ ID NO: 106 - protein, 496 aa, Acinetobacter sp. NIPH 809
MKRTLLCCLILLASSSLYADDETQLRLNQNLDQNLLQQQHQLQQQGAIRSTDELPNIVINGQVFEVEKNQDDLAKALYLAVMQKQWGNAAVYLKHYQQYDGYDKALTDFAEGALARAQGQLKIAEHKFQSSLNKQPNNLICELELARVLFEQQKNKQAARLFTSIQSKLGQSDRGVIPPEVEQTVKLFVKALEQRDSWQGSVAIGPTYATNLNSSSEQSKTWMLYGLDQKGNVIPIQEITRGSPKAESATGMDYEASLMKRFSLYGNHGVSLRGLAYGQSYDDHADFNESTLNINAGYSFFDLKNQITIAPLFEHKRYANDGLYNAWGARAEWMRFISADKALKLEAEIKDLNYQTYKTLDGKESSAMLTFWKILPEQWTLFGGADVLDHDTQEKYMAAYQQQGVRLGLSKPWSAGFNTTLFSLYRWRQFDRYVAAFQTRRQDFEQNYTFVLQMPRFKFYGMTPNLTYRYNRNNSNVDWLYSYDKHNVSLKLEHRF

SEQ ID NO: 107 - DNA, 1491 bp, Acinetobacter sp. WC-323
atgaacaaaacattgctgtgctgtgtgattttactggctgcttcatcactctatgccgatgatgagacacaactccgccttaatcagagtctggatcagaatctgttccagcaacagcatcaattacaacaacaaggcaccattcgtgacaccgagaaactacccagcatccgtattaatggccaaatttacgcggtagagcagaatccggatgatctggccaaagcgctatatctggcggttatgcaaaagcaatggggcaatgctgcgatttacttaaaacactatcagcagtatcaaggctatgatcaggctttaaccgattttgccgaagcggctttggcgcgcgctcagggaaagctcaaattagccgaacaaaaatttcaaagtagtcttaatcaacaaccgaataatctgatttgtgaactcgagttagcgcgcgtgctgtttgaacagcagaagaataaacaagcagcacgcctttttacatcgattcaggacaagctagggcagagcaatggggcaatgatcccaccagaagtgcaacaaacggttgatctgttcgtcaaagcacttgatcagcgggattcgtggcaaggcagtgtcgcaattggcccatcctatgccacaaatctgaatagctcttctgaacaaagcaaaacatggaccttgtatggcattgatgacaagggcaaggcgactccaattcaggaaattacccgtggcagccccaaagcagcatcagcaacaggggttgactatgaggccagtctaatcaagcgcttttcgctttcgggcaatcatggcatttccttacgcggtttagcatttgggcaatcctatgctgatcatgcgctctataacgaatccaccctgaatatcaatgcaggctatagtttttttgatttaaaaaatcaaatcaccattgcaccgctatttgaacataaacgttatgccaatgatggtttatacaatgcatggggggcacgtactgaatggatgcgatttctagcaccagacaaagccttcaagcttgaagctgaaatcaaagatctgggctatcaaaaatataaaaacctagatggtaaagaaagctcggccatgtttacattctggaaaattctaccgcagcaatggacactttttagcggactggatgtactggaccatgacacccaggaaaaatatatggcggcttatcagcaacaaggcatccgtctaggactgagcaaatcctggaaagcaggtttgaataccacgctattaacctcataccgctggcggcagtttgaccgctacgtcgagacctttgctgcacgtcgccatgattttgaacagaactataccctggttgtacaaatgccacggtttaagttttatggtatgacgccgaatttgacctatcgctacaaccataatgacagtaatgtcgactggctctattcctacgataaacacaatatcagcttaaagctggaacatcgtttttag

SEQ ID NO: 108 - protein, 496 aa, Acinetobacter sp. WC-323
MNKTLLCCVILLAASSLYADDETQLRLNQSLDQNLFQQQHQLQQQGTIRDTEKLPSIRINGQIYAVEQNPDDLAKALYLAVMQKQWGNAAIYLKHYQQYQGYDQALTDFAEAALARAQGKLKLAEQKFQSSLNQQPNNLICELELARVLFEQQKNKQAARLFTSIQDKLGQSNGAMIPPEVQQTVDLFVKALDQRDSWQGSVAIGPSYATNLNSSSEQSKTWTLYGIDDKGKATPIQEITRGSPKAASATGVDYEASLIKRFSLSGNHGISLRGLAFGQSYADHALYNESTLNINAGYSFFDLKNQITIAPLFEHKRYANDGLYNAWGARTEWMRFLAPDKAFKLEAEIKDLGYQKYKNLDGKESSAMFTFWKILPQQWTLFSGLDVLDHDTQEKYMAAYQQQGIRLGLSKSWKAGLNTTLLTSYRWRQFDRYVETFAARRHDFEQNYTLVVQMPRFKFYGMTPNLTYRYNHNDSNVDWLYSYDKHNISLKLEHRF

SEQ ID NO: 109 - DNA, 1491 bp, Acinetobacter sp. WC-743
atgaaaaaaatagtattgcttggcgttgtgctactgtgtggagaaactgtctatgcagcagatgataccagtatcaggttaaatcaggaaattagtcagcagcaatatcaaaatgataagaaactactcaaatcagatgatcccaaaaaagaccaagcattaccgaatctgatcatacaaggtcaggaatatatggtgaaggatgaacccgcagaagttgcttatgcgctttatttggcagtgatgcaaaaacaatggcaagtcgctttacgttatttagaaaaatataaaaattttccaaattatgatcaggctttgactgaattcgctgaaggcgtcatggcacgaacacagggaaatttaagcttagctgaaagtaaactacaacacagtctaaagattcaatccaataatttaatgacacagcttgagctggcacgtgtctacaccgaacaacagaaaaatcagcaaggactacagttatttcagcagattcaatctcaattgagcatgtctaccgatcctgctgctcaaggtattcttcaaactgtagagatgtatcttaaaggacttaaacaacgtgatgcatggcaaggttccttagcttttggttcacgttatgccagtaatatcaataacgcttcaaataaatacgacattgtgacctattacggtattgacccagagacgaaggaagtcgtgcctgtcgaacaattaaagcgaggtacaccagatgcgatcagtgcgcaaggtctggattatgaagccactttaaccaagcgttggtcactttctggacagcatggtattgctttacgtggattattctatggtcaagtttacccagaacagacagattataatgaattaacttttaatttaaatgcgggttatagtttttataatgaacgtaatcaagtcttggttgctcctgtatttgaacataaatactatgcacatgatccactctacagtgcttatgggttaagaggcgagtggatgcgttttatttccaacgataaagccgtcaagttagaagctgaaatgaaagatatgaactattctcagtataaggggcagaatggcacggaatattcagtctattcaactttttggaaaattttaccaaaaaactggaccttatttggtggactggatttcgttgaccataatacccaagagcaatatttcacagcatatcaacaacaaggcatacgtttagggctgtccaaaaattttaccgcaggctttaacaccaatttatttagttcttttcgttggcgtcaatttgataaatttacgcctgcattggaggctaggcgacatgattttgaacaaaactataccttgattttaagtgcgccacgttgggctttttacggtttaacaccgaatcttacttatcaatataatcaaaataacagtaatgtagagtggttgtattcctatgataaacataatatcagcttaaagttagaacatcgtttttaa

SEQ ID NO: 110 - protein, 496 aa, Acinetobacter sp. WC-743
MKKIVLLGVVLLCGETVYAADDTSIRLNQEISQQQYQNDKKLLKSDDPKKDQALPNLIIQGQEYMVKDEPAEVAYALYLAVMQKQWQVALRYLEKYKNFPNYDQALTEFAEGVMARTQGNLSLAESKLQHSLKIQSNNLMTQLELARVYTEQQKNQQGLQLFQQIQSQLSMSTDPAAQGILQTVEMYLKGLKQRDAWQGSLAFGSRYASNINNASNKYDIVTYYGIDPETKEVVPVEQLKRGTPDAISAQGLDYEATLTKRWSLSGQHGIALRGLFYGQVYPEQTDYNELTFNLNAGYSFYNERNQVLVAPVFEHKYYAHDPLYSAYGLRGEWMRFISNDKAVKLEAEMKDMNYSQYKGQNGTEYSVYSTFWKILPKNWTLFGGLDFVDHNTQEQYFTAYQQQGIRLGLSKNFTAGFNTNLFSSFRWRQFDKFTPALEARRHDFEQNYTLILSAPRWAFYGLTPNLTYQYNQNNSNVEWLYSYDKHNISLKLEHRF

SEQ ID NO: 111 - DNA, 1437 bp, Aggregatibacter sp. oral taxon 458
atgatgaaattacccttatcttttggaattgcgattggcgtattcgtgtctgcttcagcagcggcagaaattactgcaccaaagaacgcatcgcctgaagaacatttaaagctagcgagccctcaattgcctcaaaatgacgttgtagagacctccacttcaaaagaacataccctatctattacaaaagaagaacttgccaaacgaccggatttgattatccgtggcctgattccggcattgctacaaagccatgtggaggcagtggcattgttgttgcccttatacaaaaatttgccacaacaagatccttttttggtggcttggggcgaggctatgatggcgacgcatcaagggaattatgcctcagcggtgcagcaatatcgtgaattatttgcaaaacatcctgaagttttaccattgcgttatcaattagcccatgcgttatttttgaataacgataatgaagcggcgaaagatcaattccaaaaacttcgtgcggaagtgaatgatgcctcatcgcagcaaatgatcgatcagtatttaaccgcaattaaccaacgagatcagtggaaaatcaacggtggtatcagttttttaaacgaatccaatattaataatgcgccaaaagccggcacccgtattggtgcgtggaaagcttgggagcgagaacaggcgcatgggctgtcttattatgcgggggctgaaaagaaatggtcgttgcctcatcagctttttgcaaaattggtgttagatgggcaaggcaaatattattgggataataaaaaatataacgaatttaatgctcgaatcggtgccggtttggggtatcaaacggcaaatactgaacttgctttagtgcctttcactgaacgacgttggtattccggcggatcgtccggcagtgatgccatgaaacaatattctaaaaattccggtgtgcgtgttgatgtgactcattggctcaataaatcatggcaaatttcgaccgcacttgaatatggcgagcagcgttatgccacacgtaaacatttaaatggcaataattatttgtggtcgaatacgctcttatttttaccttacagcggacaatattggtatatcggtgcggattataatcgtgaaaatacgcgcgatcttgataatgcctatcagcgtaaaaacgtgcgtttaggttgggtgcaagaatggccgttgggcatttccagtcgtctttctgtcgcctatgcaagacgggcttataaaggggaagatttacttggtattcgtcaaaaaaacaaggaatatcaaaccaatgtcactttatggcatcgtaacgtgtatttttggggcattacgccgaaaatcacgtggtcataccaaaaaaatgacagcaatcatccgttttatcgctatgataaaaatcggatttatttagaaatgagcaaaacgttctaa

SEQ ID NO: 112 - protein, 478 aa, Aggregatibacter sp. oral taxon 458
MMKLPLSFGIAIGVFVSASAAAEITAPKNASPEEHLKLASPQLPQNDVVETSTSKEHTLSITKEELAKRPDLIIRGLIPALLQSHVEAVALLLPLYKNLPQQDPFLVAWGEAMMATHQGNYASAVQQYRELFAKHPEVLPLRYQLAHALFLNNDNEAAKDQFQKLRAEVNDASSQQMIDQYLTAINQRDQWKINGGISFLNESNINNAPKAGTRIGAWKAWEREQAHGLSYYAGAEKKWSLPHQLFAKLVLDGQGKYYWDNKKYNEFNARIGAGLGYQTANTELALVPFTERRWYSGGSSGSDAMKQYSKNSGVRVDVTHWLNKSWQISTALEYGEQRYATRKHLNGNNYLWSNTLLFLPYSGQYWYIGADYNRENTRDLDNAYQRKNVRLGWVQEWPLGISSRLSVAYARRAYKGEDLLGIRQKNKEYQTNVTLWHRNVYFWGITPKITWSYQKNDSNHPFYRYDKNRIYLEMSKTF

SEQ ID NO: 113 - DNA, 1296 bp, Aggregatibacter sp. oral taxon 458
atggccgaacatagtgatttacaccacttacaagaaaaccctcaacttattgaatcgtttttgtcagaaaatatatatcaattaacggcggaacaattactgacattaataaaaatctaccaaaccgtgcctcaatataatgaaaggctttttctttttgctcaaggacgaatcgcttttttacaacaaaattatgcagaagcaactcggttatatcgccttgtattatctgaaaatccgacattaaatccggtgagaattgaattggcacttgcgttgttttatcaaaagcaagatcgtgcagcacaaatgcaatttgaaaaagcaaaatcggaagcgaatcttccggaacctacactacaattcattgatgaatatctcaatgcgctgaaaacacggcaagactggaaaattgatctttcttttcattatttaagagataaaaatgtcaataatgcagcggatgccaagcagattgcgttgtcaaatcgtgccatattaaccaaatcggaaaaaatgcgtcctcagtcggcacatgggctggcgtatcatttgggcatttcgcgtgattttaatcttgttgattcccattatttgtccgtcagtaataaattatggggaaaaaattattgggataatcatgaatatgatgatatttccaaccgcactttgattggctatgcctacaaaacggcaatacaaacactaaaaatcggacctttttatgaacgccgttggtatggcaatcatcgttatcgttggaataatggcgcgcttttggaatatacccattggttaacccctaatttgcagttatctcatacgttagaaatggctaagcaacattattttgccgagcgggtattagacggtaatctaaaacttttttcatctacccttatttggcagcctaatgcaaaacaatttttctatttaggtggtgatttcatttctgaacggactcaggtgaaacaatatgcctctgatagtcaagggattcgtttaggttgggggcaagaatggggaggaggaatttcatctcaacttgggttatctgtagtgaaacgccaatataaagataccgcaaaactgggaaacctggatattttctcttttaaaaaatcacgttcagatcatatttattccgccaatatgacattttggaaacgagattggcattttgggggaataacgcctaagctacaattgaattggaagaaacaggagagcaatattccccaaatgtactcttaccaacagaaaaatatcatgctcatttttgaaagtacgttttga

SEQ ID NO: 114 - protein, 431 aa, Aggregatibacter sp. oral taxon 458
MAEHSDLHHLQENPQLIESFLSENIYQLTAEQLLTLIKIYQTVPQYNERLFLFAQGRIAFLQQNYAEATRLYRLVLSENPTLNPVRIELALALFYQKQDRAAQMQFEKAKSEANLPEPTLQFIDEYLNALKTRQDWKIDLSFHYLRDKNVNNAADAKQIALSNRAILTKSEKMRPQSAHGLAYHLGISRDFNLVDSHYLSVSNKLWGKNYWDNHEYDDISNRTLIGYAYKTAIQTLKIGPFYERRWYGNHRYRWNNGALLEYTHWLTPNLQLSHTLEMAKQHYFAERVLDGNLKLFSSTLIWQPNAKQFFYLGGDFISERTQVKQYASDSQGIRLGWGQEWGGGISSQLGLSVVKRQYKDTAKLGNLDIFSFKKSRSDHIYSANMTFWKRDWHFGGITPKLQLNWKKQESNIPQMYSYQQKNIMLIFESTF

SEQ ID NO: 115 - DNA, 1422 bp, Aggregatibacter sp. oral taxon 458
atgaaaaaacttccctattttatcattctacttcccttagttactcaagccgaaaccttccaagcaccacagcctgttttctttgaaaagaatattgtgccgaaaacggaagaaccacagataaaaacgccggagaaatccaccgcactttcagcaccgatgacatttgaatccaatgacaatacccaaactaaactggaaaaactgatcaactatagtgtggtaaaacaacaatggggcatattgaaacaaacgttgccgctttatcaatcgcaacctcagcacgatgtcacgctatatcgttatgccctaggggcaatgttgcgggcagaacgcaaccataagcaagcgattcgtctttatcagcagattgttgatgaaaagccagaactggcttatccacgttttgatttgggcgtaatgttgtttgaaaataaacaatatcgccaagccaaggcagaacttgagcgtgctaaaccggcattatccccagccatgcaacaatttactcagcgttacttggaggcaatgaaagaacgccaaggctggaaagcggatgtagaatggcaatatacccaaaccgacaatgtgaataacgcctcatctcaacaagatattttattaggtaaattgcgctttaaaaaagacaaagaatctttgccacaaaaagcacacggttttcgttatgggctgggcttaagtcgtaaaatcaatgtcgccggcaatcattttgtgaccttaaacagccgttttggcggcgtgcattattgggacaatcaagactacagtgaaaaatctctctatacagccataggctataaacatcgtacaatattacagacatggggaattacgccgttttttgagcaaaattggttaggcgcaccacgctatagccaaaattatggcattaccgtagatttacgccgtgaattaaccgcactttggtcgttctccagcacgctttcccatacgcaaaaacgctatgcggatgctaacgttgcacgccgtcataacggctatatcaatggcacaacgctctcattaagttatcaggcaaagccgaattggttacttttcggcggtgtggaaggcagcctagatcgcagtaaagacaaagcagaatcctcgcttcgtcgtggtgttaatctcggcaccgtctggcaaatcaaggatttcgcgacacgcttaagcattcggtatgtcaaacgcgattttcgggcaaaaaacttctatttcccaatgaaaaaacgacaagataaagaatatggttttaacgcctcactgtggcataacaaaatgcaatggaaaggctttattcctaagttaaattatcgttaccgtaaaattgacagtaatattcctgaattttattcccgcaccagcggagagtggtttgtgtctgtcgaacgtaatttctaa

SEQ ID NO: 116 - protein, 473 aa, Aggregatibacter sp. oral taxon 458
MKKLPYFIILLPLVTQAETFQAPQPVFFEKNIVPKTEEPQIKTPEKSTALSAPMTFESNDNTQTKLEKLINYSVVKQQWGILKQTLPLYQSQPQHDVTLYRYALGAMLRAERNHKQAIRLYQQIVDEKPELAYPRFDLGVMLFENKQYRQAKAELERAKPALSPAMQQFTQRYLEAMKERQGWKADVEWQYTQTDNVNNASSQQDILLGKLRFKKDKESLPQKAHGFRYGLGLSRKINVAGNHFVTLNSRFGGVHYWDNQDYSEKSLYTAIGYKHRTILQTWGITPFFEQNWLGAPRYSQNYGITVDLRRELTALWSFSSTLSHTQKRYADANVARRHNGYINGTTLSLSYQAKPNWLLFGGVEGSLDRSKDKAESSLRRGVNLGTVWQIKDFATRLSIRYVKRDFRAKNFYFPMKKRQDKEYGFNASLWHNKMQWKGFIPKLNYRYRKIDSNIPEFYSRTSGEWFVSVERNF

SEQ ID NO: 117 - DNA, 1464 bp, Alcaligenes sp. EGD-AK7
ttgtgcctgttgctggccatggcatccagcgcggtgcaagccaacgacgacgatacgcgccgacttctgaatcaaatcgaccgcaatctgaacgaacgcgaacgctcccatttagtggaagaaaccccgcctgatgtggacccatcggccctgatcaccatcaacggcacaacttatagcgtcgatgccacactgaccgatctggaaccggccatttatgtcgccatcaatctgcaacagtgggccaaggtggatcagtttgtagaaaaatatcaggagctgcccggccacaaccctgccctggtgctgatggctcaaggagtggtggcccgtagcaaggacaatcacagcctggcgatcagcaagctgcgccaggctcaggaaagcgatcccactatgatgcgcgccaagctggagctggcccgcgtactgttcgaggactatcaatccagcgaagcgaaagaactgttcagccagatttcctctgccggtattcctgatgaagtacggcccgtaattgaaggcttccagggtgccttgcaggaccgcaatgcctggcacggttccgcctcgattggcttgggctacaacagcaatatcaacaaagaaaacggccagcaagacaccttctttacctgctatttctttgggtgctttccgtcagtgcgcaagatgccggacccggtcaaatccaccgccatggtctacgacctgaccttgaaccggcgtttccagctaagcggcaaccacaacctactactgcgcggcctgagctacggcaatctttacgacaagcataaggaagccgagcccaaggacatttattacagcgacaacaccagcattatttacgcgggctacaactatcaggacgctaaaaacgatctgtcgattacgcccttgttcgagaacaattacaccaaccgtcgcaccagctatcagtcctggggcgggcgcgtggactggaagcacaatcttagcgacaggctgcaagtaggcgtgaatgcccagcacaagagcctgtcctacaaaggcgatttacggcagtactttgaagaagtcaaagagaaccagataggcttgtacggctcgtatctgattgatgccaaaaccgtggtctacgggggcctgaattacacccgtaatctgcagtctcagcaaaccgcgcaaagccgcagctatatggcaaacttgggaatttacagggcctttgatgcgggtttcaatatcaacgccacggcactataccggcagacccgacacgatgccgaggacttgttcctgggcgggctgcgcaaggaccgtcagcagatttatatcctgaacgtaggcatgccgcgctttgcgttccaaggcattacgcccaatttgtatgtgaaacacactttcaacaacagcaatatcgactgggctttcaaatacaagcaaaccgaagtcgcgctgaagctggaaaagcgtttttaa

SEQ ID NO: 118 - protein, 487 aa, Alcaligenes sp. EGD-AK7
MCLLLAMASSAVQANDDDTRRLLNQIDRNLNERERSHLVEETPPDVDPSALITINGTTYSVDATLTDLEPAIYVAINLQQWAKVDQFVEKYQELPGHNPALVLMAQGVVARSKDNHSLAISKLRQAQESDPTMMRAKLELARVLFEDYQSSEAKELFSQISSAGIPDEVRPVIEGFQGALQDRNAWHGSASIGLGYNSNINKENGQQDTFFTCYFFGCFPSVRKMPDPVKSTAMVYDLTLNRRFQLSGNHNLLLRGLSYGNLYDKHKEAEPKDIYYSDNTSIIYAGYNYQDAKNDLSITPLFENNYTNRRTSYQSWGGRVDWKHNLSDRLQVGVNAQHKSLSYKGDLRQYFEEVKENQIGLYGSYLIDAKTVVYGGLNYTRNLQSQQTAQSRSYMANLGIYRAFDAGFNINATALYRQTRHDAEDLFLGGLRKDRQQIYILNVGMPRFAFQGITPNLYVKHTFNNSNIDWAFKYKQTEVALKLEKRF

SEQ ID NO: 119 - DNA, 1386 bp, B. psittacipulmonis
atgggattatgcgttagtctctgtttgggagtagtccgcgcagaagtattgacagttgagccgattcattttcagtcgatcgactatcaacgtgaaaaatgggtagaggcgaacatgagcttatccaacgataccctacctctagctgaatatcagctttcgtctgtcgaggcacagattacaaaattcattcgatccaaacaatgggacgcattgatagcagtattgtaccaatatgcacagcatccgaataaagatatagccttgtactattatgcattaggtgctttgcaacgagcggaaggactgcaatcacaagcgattcatacatatcaggttttgacgaaatatcgttctgacttaatttattctcaatatgatttagccttaatgttaatggaggattatcaatatcaagaagccaaaaagttgctgacagtattaataaaacgatcagatgaagccttgtcagaaagggtttatgcacgtttacggcatattgaaaaacaacaatcatggcaaccgttttttgatattcaatacgtaaaaacggataatgtgaataatgcagcgacttcccctgtgattgtgattaatggtaaaacgtttgtcagagatgaagaaagcagaccgaaatcagctcatggcgtatcttatacaatcggtgcgacacgtcgttatcagataataggtcatcaccatttttacacttctttgggggcgaatggcacttattattgggatgccaaagactatcgcgaagagagtttgcagacggtattgggctatgtgtacaaaaatataaagcaagaatggcgagtattgcctttttgggaccataatcgcttaggtgggcacgcatacagccgttattatggtgtgagaatggggtggtttcaaaaattaggacctaagtggtgggtatcaggtagctatcaatatcgaaaaacagcttattttgatgaagtgattgccgatcgttataatgctcgtcagcattggatcttgatgaatcaacgctggttgataaatccttactggatgctatcggcaggggtggactatactcgagaatatgcatttgatccgtcgctatcttcccgtaaaaagggagtttcagcaggggtatattacgaaaaagattggggagctcatctcagcgcttattatggttggcgacattttgatcgggaacacgtgatctttgatctcaaacgcaaagacaaagaacgtcatgttagcgtatctttatggcataaaagcgctaaatggaaaggcatacagcctaccattaattacacctatcgtcgcataaaaagcaatctcagcgatttatatgatcgttctgaatcgaccgtattgattagcttttcaaaaacgttttaa

SEQ ID NO: 120 - protein, 461 aa, B. psittacipulmonis
MGLCVSLCLGVVRAEVLTVEPIHFQSIDYQREKWVEANMSLSNDTLPLAEYQLSSVEAQITKFIRSKQWDALIAVLYQYAQHPNKDIALYYYALGALQRAEGLQSQAIHTYQVLTKYRSDLIYSQYDLALMLMEDYQYQEAKKLLTVLIKRSDEALSERVYARLRHIEKQQSWQPFFDIQYVKTDNVNNAATSPVIVINGKTFVRDEESRPKSAHGVSYTIGATRRYQIIGHHHFYTSLGANGTYYWDAKDYREESLQTVLGYVYKNIKQEWRVLPFWDHNRLGGHAYSRYYGVRMGWFQKLGPKWWVSGSYQYRKTAYFDEVIADRYNARQHWILMNQRWLINPYWMLSAGVDYTREYAFDPSLSSRKKGVSAGVYYEKDWGAHLSAYYGWRHFDREHVIFDLKRKDKERHVSVSLWHKSAKWKGIQPTINYTYRRIKSNLSDLYDRSESTVLISFSKTF

SEQ ID NO: 121 - DNA, 1440 bp, B. psittacipulmonis
atgacaaacaaaatactttttacctgtttttcgatttttgcctttcaatcaacggtcgctaacattctttatacgcccaatattgctcaggaagtcaaagatcattttgatgcgtatcaacaaaatgaacagtggctcaaacaacgttcatctggccctaccgctattggtcccactatttctgattcacaaaccctatcgcttagtagccaagagctgttacagcattctgaattattagagaaagcttttattattgctttgaacacctttcaaatagggggaattgaaaaactgcttcccttgtaccgacaacttccacaagctaattctcatctaattcattatgcacaaggtctccttgcattcaagaatcaagaggcttctagcagtgcccaatattttaagaaaattctcgatgaacatcccaacgctgtcgtagcagattatttttatgccttatctagctttaaaaataaacattatgatgaggcaaacacacgttttaaagcactcttaaacactaatattcccgaaaccaaaaaacaagacatcataccgtttcatcagtttattcagaactaccaaaaatgggatgtttcattgatggtcagtcctttttatgaccaaaacatcaacaatgcccccgatcaacgtcattggaacggctttacttttgcggaaaaaatagcggactatggcatgcgttattatttatctgtcagtaaaaaaatattattgcccaaaggatgggtggtcgcaccaagcgtagccagctatggaaaaatatttaaaaatgaaaaaacctttaacgatgtcaatctcaaaacttttgtaaatatcattcaacagtcgcaatatcaggactttctcattcaaccttatttccataaacgctggtttggtaatcaagcttactcacaaagcaaaggcctgactcttggctggggacaagactggtcgtccatattgagcactcaagtcaatgtcgcttatgaacgagaaaagtttcacggtcgtacttttttaaataattacaaacaaatggctgatggtgtcatctttttatcccccagtgacacacatacctttatttttcaacaaggctttgttcatcaatatgccactcgcgaccaagatgatcgttacatttccctacgttcatccatcgcatggattcacaccttttcacatggcctaaacacgcgaatcggtgtattttatgaaagcacgcgttataaaggccccactctattaacgggccaagaaaaccgaaaagacaaagcatacggctggtcattagatgtaaaacacgcgtccatccaatacaaaggaattcaacctagtctaggttttcgttacagcaaacaccgcagtaatagtgccttacatcgttacaccaaaaaggatgttgtattcagcattcaaaaaagtttttga

SEQ ID NO: 122 - protein, 479 aa, B. psittacipulmonis
MTNKILFTCFSIFAFQSTVANILYTPNIAQEVKDHFDAYQQNEQWLKQRSSGPTAIGPTISDSQTLSLSSQELLQHSELLEKAFIIALNTFQIGGIEKLLPLYRQLPQANSHLIHYAQGLLAFKNQEASSSAQYFKKILDEHPNAVVADYFYALSSFKNKHYDEANTRFKALLNTNIPETKKQDIIPFHQFIQNYQKWDVSLMVSPFYDQNINNAPDQRHWNGFTFAEKIADYGMRYYLSVSKKILLPKGWVVAPSVASYGKIFKNEKTFNDVNLKTFVNIIQQSQYQDFLIQPYFHKRWFGNQAYSQSKGLTLGWGQDWSSILSTQVNVAYEREKFHGRTFLNNYKQMADGVIFLSPSDTHTFIFQQGFVHQYATRDQDDRYISLRSSIAWIHTFSHGLNTRIGVFYESTRYKGPTLLTGQENRKDKAYGWSLDVKHASIQYKGIQPSLGFRYSKHRSNSALHRYTKKDVVFSIQKSF

SEQ ID NO: 123 - DNA, 1452 bp, B. trehalosi
atgcaaaaattattcatttcatcactttccttaactcttgcatgtacagttttagcaaatgagcagcagaaaattaacgatcgactagaggattctcgcattcaaactgagcaaaaaatgccagatttcccaacagtaaagaaaacagcagcaccgcagcaaagtacggctaatcatagtattagtatgaccaaagaacagctcgcccaacatcctgatttagtcatacgggctttagagccggctttactttctggtaatgccgataccttatcgctgatttttcctatctatcaacaattgccagagcaatatcgccaccctttagcgactaaatgggcaatggcgatcttagcgcgagaacaagagaattataggcaatctattcgactttaccgtgaaatcttggcagaagatgcgaataatgaggtagtacgcttgcaattagccacggtacttttttcaaataacgaattagaggcagcggaagatcaatttaaaaagctacgtgctgagccattgccacaaacaattcaagtattaattgataattatcttgaagcgatcactcgtaaagatcgttggacattaagcggcgggttgacttatctaaatgatccaaatattaataatgcgccgaaatcagggacgacttatggtaactggagcgcaccaaagcgtgaaagtgcagaaggtataggctttaatcttgcgctaggtaagaaatggtcttggggcaatggtttttacaatgaattgcgcttaaatggcagtggaaaatattattgggataaccgtaaatataacgaagtgactggacgttcaagtttagggttaggttttcaaaatgccaaaacaaacttggtgattttaccttttatggagcaaacgctatatgctggtggtagccgccaaagtgaaacgttaaaacgtttttctaaagcagcaggtggaacgcttgaactacaacattggttaaattcaaaatggcagtttaatagttcttatgaatatgctgaacaacgttataccagccgtaaacatcttaatggcaattatcattatgtttccatgggaggggtatatttagtgaatgctaaacagtattggtttagcaatgtgaattatacccgaatgtccactcgagatgcggatgacagttacttccgccgtggagttaatcttggctggcaacaagaatggaattggggactttccacccgttttagtgttagcctagcagaaaaacgttataaagcaccaatgccaatcttccaaattacgcagcgaaataaagaatatgggttgcaaggttcaatctggcatcgcgctatacactattggggaattacaccaagattgacttatagttttactcgaacaaggagcaatcacgcattttatagctatgataagcaccgtgtatttattgattttagtcgctcattttaa

SEQ ID NO: 124 - protein, 483 aa, B. trehalosi
MQKLFISSLSLTLACTVLANEQQKINDRLEDSRIQTEQKMPDFPTVKKTAAPQQSTANHSISMTKEQLAQHPDLVIRALEPALLSGNADTLSLIFPIYQQLPEQYRHPLATKWAMAILAREQENYRQSIRLYREILAEDANNEVVRLQLATVLFSNNELEAAEDQFKKLRAEPLPQTIQVLIDNYLEAITRKDRWTLSGGLTYLNDPNINNAPKSGTTYGNWSAPKRESAEGIGFNLALGKKWSWGNGFYNELRLNGSGKYYWDNRKYNEVTGRSSLGLGFQNAKTNLVILPFMEQTLYAGGSRQSETLKRFSKAAGGTLELQHWLNSKWQFNSSYEYAEQRYTSRKHLNGNYHYVSMGGVYLVNAKQYWFSNVNYTRMSTRDADDSYFRRGVNLGWQQEWNWGLSTRFSVSLAEKRYKAPMPIFQITQRNKEYGLQGSIWHRAIHYWGITPRLTYSFTRTRSNHAFYSYDKHRVFIDFSRSF

SEQ ID NO: 125 - DNA, 1416 bp, B. trehalosi
atgaagaaatttccattactgtttttttttccgacattactctttgctcaagatcccaatagtacacctagccaaatagaacatattgctaaaccaacatcggcacccttacagcttgcagtggaacaatcgtctcgccacatttttaacgaagctgaattacgtgctaatcaggcattaaccgaaaaattactcagccaagctatctatactcgccagctcactaatatggaaaaactggtcacaatttatcaagattttgcccatattgacccaattttattgcgctatgctcaaggtaaaatcgcgctacttaaaggaaattattcacaagctattcgagagtttcgcactattcttgctaaacaacctgaactaaataccgtacgaattgaactggcaattgcattactacatgatcaacaaacgaatgcggcaagtgaacaattcgataaagctaaaagtgccgaaaatctaccttataaagtgcagcaactgattgaacagtatcagcaatatctggagaaaaaacaagcttggaagttcaatttctctgcccactatgtacgggatggtaatatcaataacacatccaaacaaactgaaattgagcataccggctatgtgaaacagcctaacctgttaccacaaactgcgcacggaattcactattcttttggactacaaagagattttaacctacttggctcgcattaccttagtttcgataatcaaacgcagggggaactttattgggataatcatgactacgatgaaattaccaatcgcgctttgtttggctatgcttacaaaaagtcacaccaagccacccgcgtattgccattttatgaaaaacgctggaaacatcatcaatcagaacgctggacaaacggattaaggctagaacatgcgcattggctttcttctcgctggcaacttgctactgcattcgagtatggtaaaaaacgctatttcgaccaacacatttacaatggcaactataaacttgcttcagccaccctactctggctacgtaatccgcaacaatttttctttattggcacggatttcaaccgagataaaaccgtattgaaacaacatagttctgataccaaaagcttacgtttcggctggcagcaggaatggcaaacacttggattatcaagccgcctgacccttgcttacaccgacagacattataaagacactgcggtgctgggtggcaaacttaatctgggtaaaattcgccatgatcgtgtgaacagcattaatcttaccctttggaaacgagattggcattggttcgggtttacacccaaactgcaacttggctatgctaaacatcatagcaacttaccaagcctatatgcttacacggataaaaatgcgaatctgatcatcgaaagtcgcttttaa

SEQ ID NO: 126 - protein, 471 aa, B. trehalosi
MKKFPLLFFFPTLLFAQDPNSTPSQIEHIAKPTSAPLQLAVEQSSRHIFNEAELRANQALTEKLLSQAIYTRQLTNMEKLVTIYQDFAHIDPILLRYAQGKIALLKGNYSQAIREFRTILAKQPELNTVRIELAIALLHDQQTNAASEQFDKAKSAENLPYKVQQLIEQYQQYLEKKQAWKFNFSAHYVRDGNINNTSKQTEIEHTGYVKQPNLLPQTAHGIHYSFGLQRDFNLLGSHYLSFDNQTQGELYWDNHDYDEITNRALFGYAYKKSHQATRVLPFYEKRWKHHQSERWTNGLRLEHAHWLSSRWQLATAFEYGKKRYFDQHIYNGNYKLASATLLWLRNPQQFFFIGTDFNRDKTVLKQHSSDTKSLRFGWQQEWQTLGLSSRLTLAYTDRHYKDTAVLGGKLNLGKIRHDRVNSINLTLWKRDWHWFGFTPKLQLGYAKHHSNLPSLYAYTDKNANLIIESRF

SEQ ID NO: 127 - DNA, 1461 bp, B. trehalosi
atggcttttcataagaactattttttttctgtactattttttatcccttttcctatcgctgcggaaagtttttctgcctctttttctgttcctgaaacaaatcctgttttgtctgatattaaattgcctgaaactgttttaattgaaagacgttcagtggaaccggcgcaaaatattgaattggatgcgcatttgcaaaaattaaagcaagatcaagcattgacagaaaaggttttaaattacctattacctaaagggagcgctcaaacaattcaattggtattagatgtgtaccgctcctttgcacatcccgatcagttattgatcgcacgagcagaaacaagaattgcagaaagaaatggcgatcatcaacaggcaatgtctcgttatcagcaaattcttgccaaatatcctgattttacgcctattcgaattcaatacgcccaaggtttaatgtctactcttcgacataaagaggcacaaactgaatttcagaaaattttgtcaagtcctgatttaccaccagatttagccgctttaattcgacattatcagcaggcagttaagtatcgagatcgttggaaattctcagcggcagcaaattatgtgcgtgaacgtaatgtaaacaatgcgtcaagtgcaagccaaattgagaatacagggtttgtgaaaaatagctcaatgctgccgcaaacggcacacggtataaattactatgttgcagcagagaaagattttaatttctataaagcgcattatctccactttcaaagttacttgagtggagtgagttattgggataatcacgactacgatgaaatgacatctcgtacttattttgggtatatccataaatgggcaacaaagcgtttgagttttttgcctttctatgaacgtcactggtatgccaatcatcgttataaaaatatcactggagcaagaatcagctttaatcagtggctgacgcctaaattgcaattagcactatctacagaatatggaaaatctcgttactatgatcatcgtgatttaaacgggaacggtaaatttgtctctcttgctttacattggtttcctacgcaactacgtcatttttcagtaggaagtgatttctatcgagaaaatactgcgttacgcaattatagctacgatttaaaaacagttcgtctaggttggacagaagaatggggaaaacagattgtcagccgacttaactacagttttagcgaacgtcattataaagataatctgattttaggacgaggtttccgtttttctcgtccccgtatcgaccgtatttatcaagtcaatgctacggtatggaaaaaagattgggcattgcctgtttttgagattgtgccgaaattgcaatttcgctggaaaaaacaacgtagcacatttccaagtttatacaattataccgaccgtagtttaaatctattaatcgaaaaaagtttttaa

SEQ ID NO: 128 - protein, 486 aa, B. trehalosi
MAFHKNYFFSVLFFIPFPIAAESFSASFSVPETNPVLSDIKLPETVLIERRSVEPAQNIELDAHLQKLKQDQALTEKVLNYLLPKGSAQTIQLVLDVYRSFAHPDQLLIARAETRIAERNGDHQQAMSRYQQILAKYPDFTPIRIQYAQGLMSTLRHKEAQTEFQKILSSPDLPPDLAALIRHYQQAVKYRDRWKFSAAANYVRERNVNNASSASQIENTGFVKNSSMLPQTAHGINYYVAAEKDFNFYKAHYLHFQSYLSGVSYWDNHDYDEMTSRTYFGYIHKWATKRLSFLPFYERHWYANHRYKNITGARISFNQWLTPKLQLALSTEYGKSRYYDHRDLNGNGKFVSLALHWFPTQLRHFSVGSDFYRENTALRNYSYDLKTVRLGWTEEWGKQIVSRLNYSFSERHYKDNLILGRGFRFSRPRIDRIYQVNATVWKKDWALPVFEIVPKLQFRWKKQRSTFPSLYNYTDRSLNLLIEKSF

SEQ ID NO: 129 - DNA, 1248 bp, B. trehalosi
atgatgaaaaaagcacttctttccatttttcttatcccctctctgcttttggcacaagaaacggagagcagttatcgtgtcgcggaattaaagcaagatcctgcgacaacagaacgtttgttaatctttgctttgcaaacagaacaatggttttcagtaaaacgtttattagctatttattcgacgttttcccaaacagatcagcgacttgtcagttacgccaacattcgccttgcccagcggtcattttttaattaccgaaatcgtgaagctcgcaaagcatttcaagcggtgcaaaatcaggcaaatttagccaatgaagaacgagaaattgttgagcagtatttgagtgtgattgataaacgagaaagctggcaattttcggggcgcatgaattatgtttatgataaaaacgtgaataaaacctcatcagatcatcatattgaagatacaggatttattaaaggcgagggaatgttacctcaaaaagctcacggttttgcttattcggcagaagtggagaaaaattggaatttaaacggttcacacaatctccattttgccaatgaaatcagtggcaaaagctattgggataaccatgattatgatgaattaaataatcgtacttatttgggatatgcgttccaaaatgcccaatatcgttgggcaataaggccattttatgaacgccaatggtttagcaatcatcgctatcattgggcaaatggcgtgagaatggaatatcgccaaatatttgcaaaaaattggcaaatttctaccgcttgggagtttagccagccacgttattttaaacagcaagagcgtaatggcaccattaaattagcctctgctacacttgtttatgcgtttagcgaaaaaggttatctctatttaagcacggattttatccgtgaacaaacaagggaaaaacagtacagcaatgatttaaaatcattgcgtgcagggtggaaacagacatggggtgatgacattagcacacaattaaacggttcaatttcactacgacaatataaagattttgcctctttgggtgggattttgccattaaatgcgattcgccgagataaaatctacatagcaaatttaacgctttggaaaaataattggcattggtatggattcaccccgaaggttcaatggcgatggaaacggcaaagtagcaacattccgtctatgttctcttattcggatagctatgtgcagatgctaatagagaaagcgttttaa

SEQ ID NO: 130 - protein, 415 aa, B. trehalosi
MMKKALLSIFLIPSLLLAQETESSYRVAELKQDPATTERLLIFALQTEQWFSVKRLLAIYSTFSQTDQRLVSYANIRLAQRSFFNYRNREARKAFQAVQNQANLANEEREIVEQYLSVIDKRESWQFSGRMNYVYDKNVNKTSSDHHIEDTGFIKGEGMLPQKAHGFAYSAEVEKNWNLNGSHNLHFANEISGKSYWDNHDYDELNNRTYLGYAFQNAQYRWAIRPFYERQWFSNHRYHWANGVRMEYRQIFAKNWQISTAWEFSQPRYFKQQERNGTIKLASATLVYAFSEKGYLYLSTDFIREQTREKQYSNDLKSLRAGWKQTWGDDISTQLNGSISLRQYKDFASLGGILPLNAIRRDKIYIANLTLWKNNWHWYGFTPKVQWRWKRQSSNIPSMFSYSDSYVQMLIEKAF

SEQ ID NO: 131 - protein, 374 aa, B. trehalosi
MWHYAHAALAYAKKDHQMAVFHYRQLLAKNPSLVYPRFDLALILAEDQQFRAAEWEFQQLQAHLPPELAKIARNTQAQIAENEAWQSDFYLQYTQTDNVNNASSSPIVNVNGRIFHKNEESLPQSAKGVRYGLGLSKLHNVKGNHFAGLTLNYSGIYYWDNRDYREQSLSISPSYSYRKALYRFSFSPFIEQNWLGSSRYNYQFGATVSGLRYLNSQWLVSGRFTHLQKRYFEELTASRYNSYQHQLGGGVQWQAVKNGRFFANLDGVREIARETAQSSNKWLARVGAVFQGERWAMQASIGFGKRYFADKHYLFGYKRLDTEYQANVAVWNRTWHWRGIVPKLNFRYQKIDSNIPDFYTRQNQEWFITLEKLF

SEQ ID NO: 132 - DNA, 1125 bp, B. trehalosi
ttgtggcactacgcccacgccgcacttgcctatgcgaaaaaagatcatcaaatggcagtttttcactatcgccaactgttagccaagaacccgagtttggtttatcctcgttttgatttggcgttgattttggcagaagatcagcaatttcgtgcggcagaatgggaatttcagcaacttcaagcccatttaccgccagaactcgctaaaattgcccgcaatacccaagcccaaattgctgaaaatgaggcgtggcagtccgatttttatctgcaatatacccaaaccgataacgtgaataatgcctcatcttcaccgattgtgaatgtgaatgggcggattttccataaaaatgaagagagtttgccacaatcggcaaaaggcgtgcgttatggtttagggttgagtaaattacacaacgtgaaaggcaatcattttgccggtttaacgctcaattatagcgggatttactattgggataaccgagattaccgtgagcaatcgctttctatttcgccaagttatagttaccgcaaggctctctatcgctttagtttttcgccgtttatcgaacagaattggctggggagtagtcgttataattaccagtttggagcaactgtaagtggcttgcgttatctcaattcacaatggttggtgtcgggtcgttttacccatttgcaaaaacgttattttgaggaacttaccgcaagccgttataacagctatcagcaccaactcggtggcggtgtgcagtggcaagcggttaaaaatgggcggttttttgcaaatttagatggcgtgcgtgaaattgcacgggaaacagcacaaagttcgaataaatggttggctcgagtgggagcggtttttcagggcgaacgctgggcaatgcaggcaagtatcggctttggcaagcgatattttgcggataagcactatttgtttggctataagcggttagacacggaatatcaggctaatgtggcagtctggaaccgcacttggcattggcgaggcattgtgcctaagctcaatttccgttatcagaaaattgatagtaacatacccgatttctatactcgtcaaaatcaagaatggtttatcacattagaaaaactattttag

SEQ ID NO: 133 - DNA, 1575 bp, Brenneria sp. EniD312
atgtcgtatcagccggatttgttcgccgtaatccaatcagaacaatggcgcagaaagtgtttttccccgtgggcgacgccgggtcgatttgccgtgactgcctttatccgcgttttcatcttttttctctgcctgccgctgacgggcgtcgttgtggcgcaggaacgcgacgatacgcgccgcctgctggagcagagcatcgagagccgggcgtttgagcgcgagcgcgaactgctgcgcgacgagcgggaacaacccgccgcaagccggccgacccttacccttgacggccgcacctataccgtcgaacgtaccgccgccgcgttggggcaggctctctatctgtcattgcagcaccgacagtggggcgcggcgcggcgttttctggatgaatacctaaccttgccggaccacgatcccctgctggtgcactatgccaggggaatgttggcccgcgcggccggactgctggcgcaggcggaggcggaattccgcgcgctgctggcgctgcggcccgcctttctgcccgcccggctcgaactggcgcgcgtactgttcgaggacggtcaggagcgcgaggcagaactggcgttcgtggatattctggcgtccatcaatgctgcggatcccaagacagccggggtgcgcaagacgattgcggcctaccgcaatgcgctacgacagcgcagcgattggcacggttccttttccttcggcccgacctggtccgataatgtcaaccgcacctcggcgagccagacctgtctctggctgttggcaaacggtctctgtctggtggaacgcaagctgccggacgccatctccgccggcggcctggccttcgacgccagcgcgcagcggcgcataccgctacgcggccgccacggcctctatctccgatcgtccctgtatggcgcgcaataccgtcatcacggcgactacaacgaaaccacgttcacggcgcagggcggctacagctatcgcggcgggcggcatcagttacagttggccccctccttcgaatattaccaatggggcagggaagcgctttacggcgcctggggagcgcatgccgactggagctacataccgtggcgcaacgcgctgctaaagctggaaggggagtataaggatatgagctatcggcggcgggcgtacgccaataatttcgacggcgcaacgcgccaactgtacgccacctattatcatgaagtgggcgccggctggacgctgttcggcggcgtcgattgggtggacagcgatgcgcggctggaggccaacggctaccggcagacggggctacgccttggcgctgccgtgacctattccggtttttccgccacgctgttcggcgcctaccgggtacgggactacgacgcatacaaccccctgctggcggcccgcagggaagatgacgaacagaattataccttgatcctcaaagcgccgcgctggcaggcggccggcttcgttccggtcctgaccctgcgtcataataaagtgaaaagcaacgtggactggctctactcctacgatcgcaacgatatcagcctgaagctggagcgcactttctaa

SEQ ID NO: 134 - protein, 524 aa, Brenneria sp. EniD312
MSYQPDLFAVIQSEQWRRKCFSPWATPGRFAVTAFIRVFIFFLCLPLTGVVVAQERDDTRRLLEQSIESRAFERERELLRDEREQPAASRPTLTLDGRTYTVERTAAALGQALYLSLQHRQWGAARRFLDEYLTLPDHDPLLVHYARGMLARAAGLLAQAEAEFRALLALRPAFLPARLELARVLFEDGQEREAELAFVDILASINAADPKTAGVRKTIAAYRNALRQRSDWHGSFSFGPTWSDNVNRTSASQTCLWLLANGLCLVERKLPDAISAGGLAFDASAQRRIPLRGRHGLYLRSSLYGAQYRHHGDYNETTFTAQGGYSYRGGRHQLQLAPSFEYYQWGREALYGAWGAHADWSYIPWRNALLKLEGEYKDMSYRRRAYANNFDGATRQLYATYYHEVGAGWTLFGGVDWVDSDARLEANGYRQTGLRLGAAVTYSGFSATLFGAYRVRDYDAYNPLLAARREDDEQNYTLILKAPRWQAAGFVPVLTLRHNKVKSNVDWLYSYDRNDISLKLERTF

SEQ ID NO: 135 - DNA, 1485 bp, Brenneria sp. EniD312
atgccgtatgcgccatctattctgaagatcgtcataaccacattgctgtttcctctgccggccgccatcggcgccgcccgtgggcagatgcccgtcattcccggcgaacagcgcagctttcccgcgcccgatatcgaccgccagtggcaaaaagaacagaacgaggcgctggagcgcgcgcgtcgtcgtcgggcgccgcgcggcgaaagcccggccgcgccggtattgaacgacgccgcggtggcggccaatagcgcggtggcggagctgattctggagacggcgctgcaacatcaggactgggacactatcgagcgggtgctgccgctgtacgccggccatccgcgccacgaccggcagctttatcgcttcgtcaaaggggcgatgctccgggcgcgctggcggctcgggccggccatcgacctgtatcgccaaatgctcgacgccgacccgacgctgaacaatgtgcgcttcgacctggcggtgatgcagttcgagaacaaatcctatagccaggcgaaacggcaatttttgctgctggccgataacccgcgggagccgctgttccgcgagctgtcgctaaactacctgaaacggattgccgaacgcgccaggccgtcgctcaaccttaccgccgatctgctgcacaccgacaactacaatcagggcagcgacgtggaatacatctatctgtggggcctgccgttcaggaacaacaaccgccggcagagcagttccggccagtccctgttcgtgacgctggagcaggacgtcaaccttgccggcaaccattttctgggctattcggcctatttcaacgcgcttaattacgccagagacaaccattacgacgaaagaacggcgttgctggggctggactaccagtaccagagcctgcgcgataccttttccgtcgggccggtttacacctaccggcggctggggggcgagagttatgccagggacgtcgggctgagcgccagttacggccgctggctgacgccccgctggcaggccgcgctggggtatcgtcttctggaccggcgctactatcggcaacccatcggcgagctgtacgacggcaagatcgccatccacagcctgaatctgatgcgcgccgtttcgaaccgttttctgctctacggcggggtattccacgagcgcgagaagctgggcgccgccgatgtctcttcccggcagagcggcgtcaacggcggctttacctatatcgcgcagggcggcctggacgtcagaatgcagctaagattcgggcgcaagcgctttgacgaggagaacgcctttttcggcgtccggcgccgcgacgccgtcacccgccttgcgctgcggttgcagtaccggccctggacttttcagggcattacgccgcggctggtttatcagcgtgaaaaaaccaccagcaatattccggcgttctatggcaaatcctccaatcagctgatgctctccttcagcaaggagttttga

SEQ ID NO: 136 - protein, 494 aa, Brenneria sp. EniD312
MPYAPSILKIVITTLLFPLPAAIGAARGQMPVIPGEQRSFPAPDIDRQWQKEQNEALERARRRRAPRGESPAAPVLNDAAVAANSAVAELILETALQHQDWDTIERVLPLYAGHPRHDRQLYRFVKGAMLRARWRLGPAIDLYRQMLDADPTLNNVRFDLAVMQFENKSYSQAKRQFLLLADNPREPLFRELSLNYLKRIAERARPSLNLTADLLHTDNYNQGSDVEYIYLWGLPFRNNNRRQSSSGQSLFVTLEQDVNLAGNHFLGYSAYFNALNYARDNHYDERTALLGLDYQYQSLRDTFSVGPVYTYRRLGGESYARDVGLSASYGRWLTPRWQAALGYRLLDRRYYRQPIGELYDGKIAIHSLNLMRAVSNRFLLYGGVFHEREKLGAADVSSRQSGVNGGFTYIAQGGLDVRMQLRFGRKRFDEENAFFGVRRRDAVTRLALRLQYRPWTFQGITPRLVYQREKTTSNIPAFYGKSSNQLMLSFSKEF

SEQ ID NO: 137 - DNA, 1425 bp, C. hominis
atgcgactgatccccctgataaccctaaccttattcagcagcatagccgtggcgcagaacgtcccgcccgcgccagtacgtgacaccgccacgccggacgaaaaactgcccgacaccgccgaacgcgccgccgccgacaaaaaccaggcgcgccaacaaaacgcccaagtcctgcaagtcaccgaagccgaactgctcgccgacccgccgctgctcgccaacgccctcgacagcgccatcatcaacggcgacgccgacgccgtcgccatgctattgcccatctaccgcaaactgcccgccgacaaacaagacaaaatgctgctgcgctttggcgaagccatgaaagcgcgcgccgacggcgacctcagccgcgccatcgcccgcctgcgcgaaatgattgccgaagaccccagcctgcaacccgtgcgcctgcaccttgccatggcactactcgccgaccatcaggacgaagccgcgcgcacccagctcgaaaaactgcgctcggacgaactgccggaagacatccgcaacatcgtcagccaagcgctggataccctgcgcgaacgccaaagctggaccttcaacgccagcggctactaccgccacgacaaaaacatcaacgacgcgccgcgccaacgcgaacgccaagtcggcaacggcaaatggaccttccccgaacgcaaaagcgcgcacggcgtacacttcgacgtctccgccgaacgccgcatccccatccacaacggcttctacggccaagtagaagcgggcatcaatggcgactggttctgggacgcgcacaacttcgacgacttccgcctgcgcaccggcgctggcgtaggctggcaaaactcgcgctgggacatcagcctcacccccttcatccagcgccgcatctactccaacaaaggctactccaccaacttcggcaccgacgccaacatctcctactggctcaccccgcgctggcgcctgagcagctcgatgcaggccatgcacaaaaaccacgacacccgccgctggctgaacggcaaccaatactacggcagcctgaacgtcctctttgcgccgaacgcgcgccaatactggttcgccggagcgaacgccatgcgcagccaggcaagagacagctcggacgccttcaaacgctacggcatcagcgccggctggggacaagaatggggctggggcatgtccagccgcctgagcggcaactttgcctaccgtccgtatgacagcaaagacttcttcggcatcgtgcgcaaagaccacgaatacggcgccaccctcagcctctggaaccgcaacctctacttctggggcatcaccccgcgcctgaccttctcctgggacaaaaccaagagcaaccacttctattacgacaaccacaatatggatgtctatctggagtttagtaagtcattttga

SEQ ID NO: 138 - protein, 474 aa, C. hominis
MRLIPLITLTLFSSIAVAQNVPPAPVRDTATPDEKLPDTAERAAADKNQARQQNAQVLQVTEAELLADPPLLANALDSAIINGDADAVAMLLPIYRKLPADKQDKMLLRFGEAMKARADGDLSRAIARLREMIAEDPSLQPVRLHLAMALLADHQDEAARTQLEKLRSDELPEDIRNIVSQALDTLRERQSWTFNASGYYRHDKNINDAPRQRERQVGNGKWTFPERKSAHGVHFDVSAERRIPIHNGFYGQVEAGINGDWFWDAHNFDDFRLRTGAGVGWQNSRWDISLTPFIQRRIYSNKGYSTNFGTDANISYWLTPRWRLSSSMQAMHKNHDTRRWLNGNQYYGSLNVLFAPNARQYWFAGANAMRSQARDSSDAFKRYGISAGWGQEWGWGMSSRLSGNFAYRPYDSKDFFGIVRKDHEYGATLSLWNRNLYFWGITPRLTFSWDKTKSNHFYYDNHNMDVYLEFSKSF

SEQ ID NO: 139 - DNA, 1560 bp, C. hominis
atgcgccgctttgcgttacccatcacaacaaacgagaacctcatgaatatcacccgaatgaccctcgccgtaactaccggcctgctgctcaccgctactgctgtcgcccaacccgcaccgcctgccggacgtgacattcccgtcccccttgaccgcggtaacgaacgcctttcagaagacaacatcggcaaggctgccgtagaaaacgcgccgaaacagcccacggtgcgccccgccaacaccctgccgagcgacgcggccagtagcaaggaagacatcgtctatacccccgaatacctgatggaacacccggacgagctggaaaaactcctggtcgaacttatccgccgcaacgaaaccgacggtctcaaactgctgttgccgatttatgccaaagtaccgaatcgcgatgactcgctcattgactggggcaatgccatcatcgccatgaacgagaaccgtacggatgacgccgtccgtctctatcgcaaactcgtcgccgccctgccggacaaccgcatgctgcgcttccagacggcactggcgctctaccgcaacaacgaaatgatcgccgccaaagaacagctgcaaaaactgcgcagctcggatgtctccgaagcagaccgcaaagcgctggacgaatacatcgctgccattgatcgccgcgaccaatggtcattcaacggcagtctgagctacgttcacgacaataacgtcaacggcgttgccaaaaaaggcacacgcctggaactgggcaacggccgcaccttcaccgccagccgtgagcaagaaaaagccaacggcatcagctacagcatcggtgcggacaaaaaatggtcgctcagcgacaacctctacagctcgctgcacggcgacatcagcggtgtgtactactacaacaacaaaaactacaacgacatcactgcccgcctcgccgccggtggtggctaccgcaacgcgcgcattgacgtagaagtcaccccgttcgtacaaaaacgcttctacggccagggcagcagcggcgacggcaacctgcacagctactccgaatccgccgggctgcacgtggacacctcctactggctgaccccgcgctggcgctggcaaaacagcctcgattacagctacgacaaacacatcaaaacctacaactacctcgacggcaaccgcgtcagcatcggtaacaccgtcatgttctcgccgaaccaaaaacaatactggttcgccggactggatctcagccacaaaagcgcacgcagcgcgagcgatgcctacaaccgcttctccacccgccttggctgggggcaagaatggggcaaaggcatctcgacccgcctgatcggcagcttcggcaaacgctacgccaaaggcgaagacttcttcaacatcaagcgtcgcgacaacgaatacaacgccaacctggcgctgtggcaccgcaacatccacttcttcggcatcaccccgcgcatcgtcttctcctacagcaagatcgacagcaacaacaagttctacagctacgacaccagcaaagtctatctggacttcagccgctccttctaa

SEQ ID NO: 140 - protein, 519 aa, C. hominis
MRRFALPITTNENLMNITRMTLAVTTGLLLTATAVAQPAPPAGRDIPVPLDRGNERLSEDNIGKAAVENAPKQPTVRPANTLPSDAASSKEDIVYTPEYLMEHPDELEKLLVELIRRNETDGLKLLLPIYAKVPNRDDSLIDWGNAIIAMNENRTDDAVRLYRKLVAALPDNRMLRFQTALALYRNNEMIAAKEQLQKLRSSDVSEADRKALDEYIAAIDRRDQWSFNGSLSYVHDNNVNGVAKKGTRLELGNGRTFTASREQEKANGISYSIGADKKWSLSDNLYSSLHGDISGVYYYNNKNYNDITARLAAGGGYRNARIDVEVTPFVQKRFYGQGSSGDGNLHSYSESAGLHVDTSYWLTPRWRWQNSLDYSYDKHIKTYNYLDGNRVSIGNTVMFSPNQKQYWFAGLDLSHKSARSASDAYNRFSTRLGWGQEWGKGISTRLIGSFGKRYAKGEDFFNIKRRDNEYNANLALWHRNIHFFGITPRIVFSYSKIDSNNKFYSYDTSKVYLDFSRSF

SEQ ID NO: 141 - DNA, 1452 bp, C. kuhniae
gtgggcgtgttgctgttgttgtcggcacaggtgcttgccaacggtacggtgtcggacgagcaaatccgcgaacggctgaacgacagccgcattcaggacgagagccgtcccgaagccgcgccgcccgccgccgcgcccgaaaaaccgtccgccgcccccgccgctgatgagggcaaaacgctggaattgagcaaagaacagttgttggaacaccccgatttgctggtgcgggcgctgatggcggcgctgctgcaaaacaatcccgaacatgtggcgatgctgtatccgatttaccgccgcctgcccgacaatgcgcgcgagcaggtgctggaagattggggcgcggcggtgtcggcacggcatcaggggcgttacggcgaagcggtgcgccgctaccgtgcggtgttgtcggcgcagcccgatttgctgctggcgcgtttgcagttggcaacggcattgtttgaagacaagcagtttgaagcggcagaagaccagttccgccgtttgcgcagcgaaacgtctttgcccgaccatctgcacgcgcacatcgaccaatatttggcagcgttgcggcgcggcagcccgtggcgtttcggcggcggcatgacctaccaaagcgacaaaaacatcaacaatgcccccaaaaaccccgatttgggcaacggcttccgcagcgacccgcccgaagccgccaacggcatcgccctgtcgctgaacgcgggcaaaaaatttgtgcgcggcaacgggctgtttggcgaagtgcgcgccgatgccaacggcaaatattattggaacaacaaaaaatacaatgatttttccgtgcgtacggcggcgggggcgggctatcagaacgcccgcagcagcgtggcattgctgccgtttttcgagcacacttggtatgcgggcgcgaccaagcagagcaacaagctgcaacgcttttcgcgcagcgcgggcatcaccttggaagcatcgcaccgcttcagccccaaatggcagagcaattttgtggtcgaatacgggcgtcagcgttaccgcacccgtccgcacctgaacgggcgcagcctgtttggttccgccaccgtgtcctatctgcccaatgcccgccaatattggtttgccggcatcgaccacaaccgcagccgcgcccgcgaccttgacgattccagcaaccgcaccggcgtgcgcgtgggctgggggcaggaatggggtcagggcttctccagccgcttgaccttgagccacgcccgcaaaaaccacttgggcatcaactttttcggcagccgccagcaaaaccgcgaatggggcgtaaacacttccctgtggcaccgcaaattgcactggaaaggcgttaccccgcgtttgacgtggcactaccaccgccagcgcagcaatcaggtgttttacagctacagcaaacaccgtgtctttgtcgaactgggcaaacagttttaa

SEQ ID NO: 142 - protein, 484 aa, C. kuhniae
MVGVLLLLSAQVLANGTVSDEQIRERLNDSRIQDESRPEAAPPAAAPEKPSAAPAADEGKTLELSKEQLLEHPDLLVRALMAALLQNNPEHVAMLYPIYRRLPDNAREQVLEDWGAAVSARHQGRYGEAVRRYRAVLSAQPDLLLARLQLATALFEDKQFEAAEDQFRRLRSETSLPDHLHAHIDQYLAALRRGSPWRFGGGMTYQSDKNINNAPKNPDLGNGFRSDPPEAANGIALSLNAGKKFVRGNGLFGEVRADANGKYYWNNKKYNDFSVRTAAGAGYQNARSSVALLPFFEHTWYAGATKQSNKLQRFSRSAGITLEASHRFSPKWQSNFVVEYGRQRYRTRPHLNGRSLFGSATVSYLPNARQYWFAGIDHNRSRARDLDDSSNRTGVRVGWGQEWGQGFSSRLTLSHARKNHLGINFFGSRQQNREWGVNTSLWHRKLHWKGVTPRLTWHYHRQRSNQVFYSYSKHRVFVELGKQF

SEQ ID NO: 143 - DNA, 1404 bp, C. kuhniae
atgttgctgctgcccgttgccgcttgggcagaacacagcccgacaccccccgcccgtcccgaacctttgcccgaccccgcgcctgaaatccgtgccgaaccgcccgcaacggcaaccccgcccgcaccgccccaagcccacaccataaagctttccgcagacgaattggcacggcagccccgtttgctgcaccgcgccctcaccgccgccgtcttgcgccaacaccccgacaacatcaaactgctgctgcccctgtatctgcgtttgcccgaagcccaacgcggcgacaaagtgctgattgaattggcacaagcggcgttggcagaacaggcgcaacatcccggccgcgccgccgcccactaccgcaatgcactcgcacacgaacccgatatgcctgtggtgcgcctgaatttggctgccgcactcacccgcgaccaccaaaaccgcgatgccgatgccctgcttgccgacatcgccgccgaccccgccctgcccgaacgcaccgccgcatcggtggcaaacgcccgcgccgccatcgccgaacgccgccgttggcacattcacgcgggcggacactacgtccgcgatgccaacatcaacaacacacccaaacaacgggtcatcaaacgcggaagcggcaccatcgaattgcccaagcccgaagccgtgcaaggcttcgcctaccgcgccgaagccgaaaaagactggatgctgcccaaaaaccaccgcatccgcaccgccctatcgctcaacggcagagactattgggaacactccaaatacgatgaactgaacgtccgcgcccaagccggccccgcctaccgcagcgcccgcagccaaagcgccctgatgccctattacgaacggcgttggtacagtggcagccgctacgccgccgaaaaagggctgcgcatcgaacacagccgccacttgggcaaacgcgcccacttgtcctttgcgggcgaagccgcacgcctgcgccacgaccgccgccgctttctggacggcgcatcgttcaacgcttcggcagatttgacgtgggttgttaccccgcgcagccgcttgggcatcggcaccgattttgcccgcaaacgcgcccaagaccccagcgacgcctaccgccgccgcaaccttcgcgccacttgggggcaaacatggggcaaagggctgaacacctccgtacacgctgccgccgccctgcgccgctacgatgccgccgactttttcaacatcacccgccgcgacaccgaatacagcctttccttcagcgtgtggcacaacaacatcaaattttggggcatcaccccgcgcttggtgggcgtgtaccaaaaaaaccgcagcaaccatttcatgtacgactaccaaaaagcctacggtttcatacgcttggcaaaatcgatttaa

SEQ ID NO: 144 - protein, 476 aa, C. kuhniae
MAMKTTPCLMLLLPVAAWAEHSPTPPARPEPLPDPAPEIRAEPPATATPPAPPQAHTIKLSADELARQPRLLHRALTAAVLRQHPDNIKLLLPLYLRLPEAQRGDKVLIELAQAALAEQAQHPGRAAAHYRNALAHEPDMPVVRLNLAAALTRDHQNRDADALLADIAADPALPERTAASVANARAAIAERRRWHIHAGGHYVRDANINNTPKQRVIKRGSGTIELPKPEAVQGFAYRAEAEKDWMLPKNHRIRTALSLNGRDYWEHSKYDELNVRAQAGPAYRSARSQSALMPYYERRWYSGSRYAAEKGLRIEHSRHLGKRAHLSFAGEAARLRHDRRRFLDGASFNASADLTWVVTPRSRLGIGTDFARKRAQDPSDAYRRRNLRATWGQTWGKGLNTSVHAAAALRRYDAADFFNITRRDTEYSLSFSVWHNNIKFWGITPRLVGVYQKNRSNHFMYDYQKAYGFIRLAKSI

SEQ ID NO: 145 - DNA, 1404 bp, C. kuhniae
atgccccatctgatgttgagaaccgcttggcaaaccatcgtatttttcggctgctgtgccgccgccgccgcttcaccgccgccgcaaggcgtgtgggacgatgcggcactgatgcaacaacctgcgctgttggaaaacctgctgtaccgtgcattggacggcggcgatgcccgactgctggcatcgcttgccgactcctaccgccgcaccgcttcgcccgaccccgtcttgctgctgcgggcagatgccgtgcaactgcgcctgaacaaacgtttggacgaagccgaacaggcataccgccgtttgcccgccgcttatcccgatgccgtgcgcgaccgtttggacttggcggcggtgctgtttgaaaacggcaaaatccgcgaagcggacgccgaatttgccgccgtatcggcacaaagcggcttgcccgccgccgtgcgcgacaacatcaacgtgttccgccgcgccatcgaccgccaaaaacaatggcgttttgccgcgacattccgccccgtgtacgaccacaacgtcaatcaagccccgccgccgcactgcatcaaagatgcgtactgcacccgcacccgcgcccaacgcgcttacggcgccgcctatgcgctgggcgcggaaaaacgcctgcccctgcgcggcaaacacggcgtgctgctgcggctgcatcagggcgggacgttttatttcggacacaaggaccacaacgaagccgccgcccgtgccgatttgggctggcaataccgcgatgcgcggcgcgaatgggcatggctgccgttttaccaagcacatttggcgggcaacgcgtcttttgatgcgccgcgcccgcagcgtaccctgccctatgcctaccgccacgatgcgggcatggcagtgcattggcacgaacggctgacaccaagcagcagcgcgcgcctgacggtggaacgccgtttcagccgttaccgcgaagcggcgcacgcccgccgtctgaacggcacgcaagatgcggcaacgctggtgttgggcaaacacttcggcacgcataccgccgtgttcggcagctaccgcgccgtgcgcttccaaccggcgcgggaacgcatcggcacggcgcaaaacaatgcggcatttgtgtttcacggcatcggtgcgggctggacgcaatcttggcgcaacggcttgcacacgcagttgtcgctggattacggtgtgcggcgttatcgcggcattgccgcattcgacacgcagccgcaacgcaaccgcgaatacgctttcggcgcgggcatcgcccaccgcaagctgcaatggcggggctggcaaccgatgctgcactaccgctacagccgcacccgcagcccgcagccttgggcagaacgccgccgccatgatgcgggcatcggcgtggcggcggatttttag

SEQ ID NO: 146 - protein, 467 aa, C. kuhniae
MPHLMLRTAWQTIVFFGCCAAAAASPPPQGVWDDAALMQQPALLENLLYRALDGGDARLLASLADSYRRTASPDPVLLLRADAVQLRLNKRLDEAEQAYRRLPAAYPDAVRDRLDLAAVLFENGKIREADAEFAAVSAQSGLPAAVRDNINVFRRAIDRQKQWRFAATFRPVYDHNVNQAPPPHCIKDAYCTRTRAQRAYGAAYALGAEKRLPLRGKHGVLLRLHQGGTFYFGHKDHNEAAARADLGWQYRDARREWAWLPFYQAHLAGNASFDAPRPQRTLPYAYRHDAGMAVHWHERLTPSSSARLTVERRFSRYREAAHARRLNGTQDAATLVLGKHFGTHTAVFGSYRAVRFQPARERIGTAQNNAAFVFHGIGAGWTQSWRNGLHTQLSLDYGVRRYRGIAAFDTQPQRNREYAFGAGIAHRKLQWRGWQPMLHYRYSRTRSPQPWAERRRHDAGIGVAADF

SEQ ID NO: 147 - DNA, 1434 bp, C. kuhniae
atgataaaaaacattgttcggacaagcatggcagcatggctgctggcatgggcatctgtattgcccgccgccgacaacaccaccctgccgggcaaaccgttgggcaaaaccgcacaagcgccgtccatgctttccgaaagcgaacagcagcaattggaacgcgcactggtggtatcggtaaacccctacgacattgcccgcgccaatcaaaatgccgtgcgctttcttgccaacgaataccgcacccgcgtgtctgccgacaagcgcgatgattcgctgctggattgggcagacattattctaaacatcggcagcgactggcagcgcaccgtgcagcaataccgcaaattgctggacaaatttccgcagcagtccctattgcgttttcaattggcacaggcattgttccacaatggcgagcctgatgcggcgcagcgcgaatttgaaaaattccgtgccacgccgaacctcaccctaaaccatgaaaaagaagccgaccgttggattatgcaaatccagcagcgtcaaaaatggcagtttgatttgcagtttcagttgctcaacaacagcaatgtgaatcaggcgccccgccataccgtgtattaccgtttgcccggcggcgcaacgttttccaatgccgaaaccgcacagcgcggctacggctaccgtctcgggctgaacgcgcaaaaacgttggcatctgcctttgcgttatcatgctttgcgcttgaatacgggcttggatttcgaccattatttgaatctgaaaaaatacagccgcatcgataccaatgtgggtttgggctggctctacgaaacgccgcgccatcaggcggaagtccagccgttttggcgcaaggcgtggaatgcgcggggcgaaggaaggcgcaaagaaggacggatgttgccctattcagacgaatacggtgttcgttttcgggtgtggcattggctcaatacccgttttcaatacgatttgatgtatcagccttcttatgtcaaatacgataatcccattgtggcgcgaacttccgatgcttcacgccattttgtccatgcatcgctgagttatcagcccaacagcaagcaaaattggcaattgggcgcacattggagcttgctcaatgccaaagacaaaaccaatgccaataaaactgtgggggtgaatttgggctggcgtcaggagtggccgaaaagtttctacaccgatttaacagtcggggcatctcgggtacgcaatcaggcgccttattggtttggcttgcggcgcaccaatcacatttattcggtaaacgcgcaagtattcaatccgacttggcagtttaaaggctttatgccgcgcttggtggtgaattatcagaaaaacaaaagcaatctgaccacccagtcgtatgatacgcgtgatgcttatatttttattcagaaaactttttaa

SEQ ID NO: 148 - protein, 477 aa, C. kuhniae
MIKNIVRTSMAAWLLAWASVLPAADNTTLPGKPLGKTAQAPSMLSESEQQQLERALVVSVNPYDIARANQNAVRFLANEYRTRVSADKRDDSLLDWADIILNIGSDWQRTVQQYRKLLDKFPQQSLLRFQLAQALFHNGEPDAAQREFEKFRATPNLTLNHEKEADRWIMQIQQRQKWQFDLQFQLLNNSNVNQAPRHTVYYRLPGGATFSNAETAQRGYGYRLGLNAQKRWHLPLRYHALRLNTGLDFDHYLNLKKYSRIDTNVGLGWLYETPRHQAEVQPFWRKAWNARGEGRRKEGRMLPYSDEYGVRFRVWHWLNTRFQYDLMYQPSYVKYDNPIVARTSDASRHFVHASLSYQPNSKQNWQLGAHWSLLNAKDKTNANKTVGVNLGWRQEWPKSFYTDLTVGASRVRNQAPYWFGLRRTNHIYSVNAQVFNPTWQFKGFMPRLVVNYQKNKSNLTTQSYDTRDAYIFIQKTF

SEQ ID NO: 149 - DNA, 1446 bp, C. steedae
atggcgttgtgctgtgctgtgtggctgttgcccttggcagcggctgccgatgcgcccgaagcggtacaaaaacagctcaacgaccgccgtgtgcaggacgaacaccgtccagaggttgcgcctgtggtgatgccgaatgccaatacgcctgcggcggcggcaggcgataccactttggaaatcagccccgatgatctgttaaaacgccctgatttgttggtgcgggcgatgatggcggcgttgttgcacaaccgtggcgaacacattgatattttgctgccgatttaccgccgtttgcccgattcggtgcgtgaaaccgttttggaacattgggcggcggcggtttcggcgcgttataacgggcagtaccgtcaggcggtgcgccactaccgcgcagtattgtcggagcagcccgaattgctgatggtgcgtttgcaattggcagcggcattgtttgaagacaagcagtttgaagcagcagaagaccaattccgccgtttacgcagcgaaagtgctttgcccgatgccctgcacgcgcaaattgaccaatatttagatgccatccgccgtggcagtccgtggcagtttggtggtggcattacctatttaaacgacaaaaacatcaacaacgcccccaaaaatcccgatttgggcaacggcttccgcaccgacccacccgaatcaggcaacggcattgccctgtctgccaatgctgctaaaaaatggattggcggtaagggcgcgtttggcgaagtgcgttttgacaccaatggcaaatatttttggaataacaaaaaatacaatgaactgactgcgcgtgccagcgtgggtggcggttttcagaatgcccgcagcagcattgccctgttgccgttttttgagcatacttggtatgcgggcggcaacaaaaaaaatgaaaaactgaaacgtttttcacacagcagcggcgtgggtgtggaagcctcgcaccgcttgtccccgcactggcagggcagtgtggcagccgaatacagccgtcagcactaccgcaaccgcccgcatttaaacggacgcaccctgtttgcctccaccaccatgtcttacctaccaggggcgcgacaatactggtttggcgggctggaccacacccgtgtgcgtacccgcgaccgtgacgattcctacaaccgcagcggcattcgcgcaggttggggtcaggaatggggcaaaggcttgtccacccgcattaccgttaattacgcgcacaaacgttatctcgcccccaattttttcaacagcgcacaaaaaaaccgcgaatacggcgtacaaaccgccttgtggcaccgcaaaattcactggttgggcattaccccgcgcctgatttggagccaccagcgcaaccgcagcaaccaagccttgtacaactaccaaaaaaaccgcctgtttattgaagcagcaaaacagttttga

SEQ ID NO: 150 - protein, 481 aa, C. steedae
MALCCAVWLLPLAAAADAPEAVQKQLNDRRVQDEHRPEVAPVVMPNANTPAAAAGDTTLEISPDDLLKRPDLLVRAMMAALLHNRGEHIDILLPIYRRLPDSVRETVLEHWAAAVSARYNGQYRQAVRHYRAVLSEQPELLMVRLQLAAALFEDKQFEAAEDQFRRLRSESALPDALHAQIDQYLDAIRRGSPWQFGGGITYLNDKNINNAPKNPDLGNGFRTDPPESGNGIALSANAAKKWIGGKGAFGEVRFDTNGKYFWNNKKYNELTARASVGGGFQNARSSIALLPFFEHTWYAGGNKKNEKLKRFSHSSGVGVEASHRLSPHWQGSVAAEYSRQHYRNRPHLNGRTLFASTTMSYLPGARQYWFGGLDHTRVRTRDRDDSYNRSGIRAGWGQEWGKGLSTRITVNYAHKRYLAPNFFNSAQKNREYGVQTALWHRKIHWLGITPRLIWSHQRNRSNQALYNYQKNRLFIEAAKQF

SEQ ID NO: 151 - DNA, 1437 bp, C. steedae
atgaaaaaaatcccctatatctgtctgctgctgcctgctgctgcatgggcagacggcaatccctatccgcttaacccacccagcgaacccgaaccgcgttttgacgttgcccccgaaccgcgccgcgacagcgagcctattccccccgcaacacctgcacccaccgagccaaaaaaactgaaagtgtcgcccgaagagctgctgcaacagcccgaattgctgcatcgcgcccttacttccgccgttttgctgaaaaatattgaaggcatcaaagttctgctgccgctgtatcagcaattgcccgaagcccaacgccgcgacaccattttaattgagctggcgcaagccgcgcttgccgaagccgaacagcgtcccgaccgcgctgttcgccattaccgcgaagcactcaaacacgaagccgatatgccctcggtgcgcctgaatctggcgggtgcattggtgcgcgaccagcaaaaccgcgaagcccaagccctgttggacgacatcgctcaagacccacaactgcccgaacccgccgccgctgcggtaaacgcctaccgtcgggtgctgaaacagcgcagccgttggcaattgagcgcgggcgcacactatatccgcgaccccaatatcaacaacaccccaaaacaacgcattattaaacgaggcagaggcacgtttgaactgcccccgcccgaaaccgcgcacggtttgtcctaccgcgccagtgctgaaaaagattggatgttgccccaatactaccgcatccgcacaggcatcgatttaaacggcaaagactattgggaccattccaaatacgacgatttaagcgtccgcgcccaagcaggtgtggcacgacagagcgcccgcagcgaaagtgccttactgccctattacgaacggcgttggtacagcggcagccgctattctgccgaaaaaggcattcgtgccgaacacagccgtcccgtcagccactcactgcgtgtgtcgctggcaggcgaagccgcccgtgtgcgccacgaccgccgccgttttttagacggcgccagcttcaacgcttccgccaccgtattgtggacacccaacgcccgcagttattttaccctcggcaccgatttttcccgcaaacgcgcccttgacccgtctgatgcctatcaccgccgcggtatgcgcggcagttggggacaggcttggggcaaaggtttccaaaccgtgctgcacgcaggcatcggcagacgcagctacgatgcggcggattttttccgcatcacccgccgcgacaccgaatacaacctttccttaagcgtgtggaacaacaaactcaaactttggggtgttaccccgcgcttggtgggcgtgtatcaaaaaacccgcagcaaccattttgtttacaactaccgcaaagcctatgcctttatccaattgagcaaatccatttaa

SEQ ID NO: 152 - protein, 479 aa, C. steedae
MMKKIPYICLLLPAAAWADGNPYPLNPPSEPEPRFDVAPEPRRDSEPIPPATPAPTEPKKLKVSPEELLQQPELLHRALTSAVLLKNIEGIKVLLPLYQQLPEAQRRDTILIELAQAALAEAEQRPDRAVRHYREALKHEADMPSVRLNLAGALVRDQQNREAQALLDDIAQDPQLPEPAAAAVNAYRRVLKQRSRWQLSAGAHYIRDPNINNTPKQRIIKRGRGTFELPPPETAHGLSYRASAEKDWMLPQYYRIRTGIDLNGKDYWDHSKYDDLSVRAQAGVARQSARSESALLPYYERRWYSGSRYSAEKGIRAEHSRPVSHSLRVSLAGEAARVRHDRRRFLDGASFNASATVLWTPNARSYFTLGTDFSRKRALDPSDAYHRRGMRGSWGQAWGKGFQTVLHAGIGRRSYDAADFFRITRRDTEYNLSLSVWNNKLKLWGVTPRLVGVYQKTRSNHFVYNYRKAYAFIQLSKSI

SEQ ID NO: 153 - DNA, 1392 bp, C. steedae
atgttaagaagcaattggctgcacattatttttttatgcgcctgctggcaagcccacgcacaaatcccgtccgacactgtttgggacaatcagcgtttgcagcagcaacccgaattattggaacggctgcttattgatgccatggacggcagcgatgccaagctgttggcatctttaaacgaagcctatgcccaactgccacaagccgatgagttgttaaaaatgcgggcgcaagccgtattgctgcgtttaaatggacgtttggacgaagccgaagacctgtatcgccgtttgccgcacgaccactccaaccatttgcgcgaccgtttggacgaagccgctgttttatttgaaaacggcaaaacccgtgaagccgatgctgcattcgccgcactcgccgaagaaaccctgcctgccgccgttcacgccaatatcgcccgtttccgtcacgccatcgcccgccgccaacaatggcagtggggttttgcgctgcaacccgtttataacgacaacatcaacaacgccccgccgccgcattgtttaaacggcgtgtactgcacccgcaccaccgcgcaaagcgcatacggtggcagttacgccatacagcttgccaaaacacagcccctgcatggcaaacacaatctggcagtacagcttcaacatgatggcacattttattttgggcaaaacggttacaatgaagcatcggcgcgtgctgctttgggctggcaataccgcgatgcccgacatgaatggtcgctgctgccgttttaccaaatccgtttagaaggggcagaatcgtttagtggcaaccgtgcggcgcgtgctttgccttacgcacaccgacacactttgggaacgcgcttggcttgggcataccgccccgacagatacagcttgttccgcattcaattggaagcgcaacgccaccgctaccgcgacgctgcctacgcacaacgtcaagacggtaatcaatggtcgtcagccatatcgtttgccaaacaaatcacgccgcaagcttcgctgtctgctgcttaccgttatgaattattccgccccaaacaccagcatatcggcgcatttgaaaacaatgctgcgtttcagtttcatggattatcgggcgtgtggtcgcaacattggcaaggcacaggtacagacacgcgcttgtcggcgcattacggcatcagacaatatcgcggcatcgcggcattcggcacgcaggcacagcgcaaccgcgaatacggcgcgggtattgccgtcagtcagcggcaactgcaatggcgcggctggcaacccgttttgttttaccaacacagtcgcatccgcagcaatatgccgtgggcgcaacggcgcaagcgttcgttcggtatcggcttggaagcgggattttga

SEQ ID NO: 154 - protein, 463 aa, C. steedae
MLRSNWLHIIFLCACWQAHAQIPSDTVWDNQRLQQQPELLERLLIDAMDGSDAKLLASLNEAYAQLPQADELLKMRAQAVLLRLNGRLDEAEDLYRRLPHDHSNHLRDRLDEAAVLFENGKTREADAAFAALAEETLPAAVHANIARFRHAIARRQQWQWGFALQPVYNDNINNAPPPHCLNGVYCTRTTAQSAYGGSYAIQLAKTQPLHGKHNLAVQLQHDGTFYFGQNGYNEASARAALGWQYRDARHEWSLLPFYQIRLEGAESFSGNRAARALPYAHRHTLGTRLAWAYRPDRYSLFRIQLEAQRHRYRDAAYAQRQDGNQWSSAISFAKQITPQASLSAAYRYELFRPKHQHIGAFENNAAFQFHGLSGVWSQHWQGTGTDTRLSAHYGIRQYRGIAAFGTQAQRNREYGAGIAVSQRQLQWRGWQPVLFYQHSRIRSNMPWAQRRKRSFGIGLEAGF

SEQ ID NO: 155 - DNA, 1428 bp, C. steedae
atgaaacgcatcattctgtcccttatcggcacttttattttgtgtaccacagcattcgccgaaaataccaccgttccgggtaaacccttgggttctgctgtttccacacccgatactcaaaccttatccgcaaacgaacaacaacaattggaacaagcattagctgttgccattaatccttacgacatcacccaagccaaccgcaatgccgtgcgctccctcagctatgcctaccgcacccgcgttcctgccgaaaaacgcgatgattccctgctggattgggcagatatcattatggatgcaggagaagactggcaaaaaaccgtacagcaataccgcaaactgctggcaaaattccccaaacaggaactgctgcgctttcaattggcacaagccctgttgtacaacggcgaacccgatgccgcacaaaacgaatttgaaaaattccgcgccacgcccgatttaaccgtaaactatgaaaaagctgccgaccgttggattatgcaaatccagcaacggcaaaaatggcagtttggttttacctttcaatttctgaacaacagcaatgtcaatcaggcaccccgccacaccgtttattatcagcttcccggtggtgctactttttccaactccgaaaccgccaaacgcggctacggcttccgcgtgggctttaatgcgcaaaaacgttggcatttaccgtggcgacgtaatgccttgcgcctcaatacaggcatagattgggaccactattttaatgccaagaaatacagccaaatcaacaccaatatcggtttgggctggctgtatgaaaccccgcgctatcatgccgaattccaaccgtttttacgcagcaattggaatgcgcgcggcgaaggcagacgggaagaaggacacttggcacgttattcagacgaatatggcgcacgtttccgcgtttggcgttggttaaacagccgttttcaatacgatttaatgtaccagccctcttatatcaaatacaataatcccttggtggcacgtacatcagacggcgtacgccattttgttcattcatcgctttcttatcagcaaaacgacaaacaaagctggcaattgggcatgtattggagccgtttaaataccaaagacaaaaccaatgccaataaaacggtaggggttaatttgggttggcggcaagaatggcccaagaatttttataccgattttactgtgggtgcttcccgcacacgcaatcaaaagccctactggtttggtttacaaagaaaaaaccacagctattcggtaaatgcccaagtatttaaccccacatggcagtttaaaggatttatgccaagattggtttttaactatcaaaaaaccaaaagcaatttaaccacgcaatcatacgatacgcgggacgcttatatttttattcaaaaaaccttttaa

SEQ ID NO: 156 - protein, 475 aa, C. steedae
MKRIILSLIGTFILCTTAFAENTTVPGKPLGSAVSTPDTQTLSANEQQQLEQALAVAINPYDITQANRNAVRSLSYAYRTRVPAEKRDDSLLDWADIIMDAGEDWQKTVQQYRKLLAKFPKQELLRFQLAQALLYNGEPDAAQNEFEKFRATPDLTVNYEKAADRWIMQIQQRQKWQFGFTFQFLNNSNVNQAPRHTVYYQLPGGATFSNSETAKRGYGFRVGFNAQKRWHLPWRRNALRLNTGIDWDHYFNAKKYSQINTNIGLGWLYETPRYHAEFQPFLRSNWNARGEGRREEGHLARYSDEYGARFRVWRWLNSRFQYDLMYQPSYIKYNNPLVARTSDGVRHFVHSSLSYQQNDKQSWQLGMYWSRLNTKDKTNANKTVGVNLGWRQEWPKNFYTDFTVGASRTRNQKPYWFGLQRKNHSYSVNAQVFNPTWQFKGFMPRLVFNYQKTKSNLTTQSYDTRDAYIFIQKTF

SEQ ID NO: 157 - DNA, 1425 bp, C. valvarum
atgcgcatcctcccagcacttttccccgccctgcttgccagcagcctctacgcagcccccaatccggtggtaaccacccccgacctgcacacccccgatgaaaaactgcctgcttcggcggaaaaagcggcggcagatacgcaaaagaaccggcaggtaaaaggaaacgtcatggaagtgaccgaagagcaactgttggccgatccacctctgctcgccaatgcgcttgacagcgccatcatcaacggtgatgccgatgccgtcgccatactgctgcccatctaccgcaaactgcccgccgacaaacaggacaaaatgctgctgcgcttcggcgaagcgatgcaggcgcgcagcaccggtaatctttcgctggccattgcccgttaccgggaaatgattgccgaagaccccagcctgcaaccggtgcgtctgcatttggcgatggcgcttatggccgatcatcaggatgaagcggcgcgtggtcagctggaaaaactgcgctccgacaaactgccggacgacatccgcaaaattgtggacgatgcccttgccaccctgcgcgagcaacgcagctggaccttcaacgtcggcggctactaccgctacgagaacaacatcaacggcgcgccacgtgaacgtgagcgtcggggcggtcgcggtacctggaccttcccggcaccgaaaaaagcgcacggcattcaccttgatctctccgccgagcggcggatgcccactgcaaacggctggtatgcgcaggtcgaaggcagcgtgaatagcgactggtactgggacgcccacgattacgacgacttccgtttccgcctcggcatgggcggtggctggcagaatgcccgctgggacgccagcctcattcccttcgtgcagcgccgtatctacgccgggcaggggtattcgaccaacctcggcgccgatgccaacgtctcctactggctcaccccgaaatggcgcttgggcacctccgtccagattatgcacaaacagcacgaccgccgcgaatggctggacggcaaccagtactacggcggcctgagcactctctacacaccgaacgcgcgccaatactggttcggtggcgtcaatgccatgcgcagcaaggcacaggaccgctcggatgccttcaagcgcttcggcgtcaacctcggttggggacaggaatggggctggggtatgtccagccgcctggttggtacctacgcgcggcgcaactacgacggactcgactttttcggcatcaaacgcaaggataaggaatacggggtttccctcagcctttggaaccgtaacctctacttctggggaattaccccgcgcctgaccttcagctggaaccgcaccgccagcaaccacttctactacgatgaccacgatcaggatgtgtacctcgaactgagtaaatcgttctga

SEQ ID NO: 158 - protein, 474 aa, C. valvarum
MRILPALFPALLASSLYAAPNPVVTTPDLHTPDEKLPASAEKAAADTQKNRQVKGNVMEVTEEQLLADPPLLANALDSAIINGDADAVAILLPIYRKLPADKQDKMLLRFGEAMQARSTGNLSLAIARYREMIAEDPSLQPVRLHLAMALMADHQDEAARGQLEKLRSDKLPDDIRKIVDDALATLREQRSWTFNVGGYYRYENNINGAPRERERRGGRGTWTFPAPKKAHGIHLDLSAERRMPTANGWYAQVEGSVNSDWYWDAHDYDDFRFRLGMGGGWQNARWDASLIPFVQRRIYAGQGYSTNLGADANVSYWLTPKWRLGTSVQIMHKQHDRREWLDGNQYYGGLSTLYTPNARQYWFGGVNAMRSKAQDRSDAFKRFGVNLGWGQEWGWGMSSRLVGTYARRNYDGLDFFGIKRKDKEYGVSLSLWNRNLYFWGITPRLTFSWNRTASNHFYYDDHDQDVYLELSKSF

SEQ ID NO: 159 - DNA, 1572 bp, C. valvarum
atgccgcgctttcatcgccaacacaggaatctcaagatgaccacaaaaaccactataaccctgcaactcacactcgcttccggcatccttttcgccgccatgcctgctgttgcccaaaacgcgcccccgccatcacgcgccctcccggtagatattgaccggggcaatgagcgcctgtccgaggatgatgtcggcaagaatgtacggctgccacaagtgcctgctgtcaaacccgccgcccccaccaccctgccgagtgatgcccaggctgccaaagaagatgtcgtttacactcccgaagaactcgccaacaaccccgaacaactggaaaaactcctggtcgaggctatccgtcttaacgaagtcgaaggcctgaaggtactactgccgctgtacgctaaagtagatgccagccgccgtgatgattccctcattgactggggtaatgccattatcgccatgaacgagggccgcaccgccgaagccgttaccctttaccgcaaacttatcgccaacctgccggataaccgcatgttgcgcttccaaacggcccttgcgctctaccgcaacaacgaactcctcgccgccaaagagcaactgcaaaaactgcgcagtggcgatgtttccgaagccgaccgcaaaaccctggatgaattcatcgccgccattgaccgccgtgattcctggtcgttcagcggcagcctgagctacattcacgacaacaacgtcaacaacgtcgccccgaaaggcacccgcttccgcctcagtaatggccgttccctcgagagcaatcgcgatcaggaaaaggccaacggtatcagctataacctggatgcagacaaaaaatggtccattaccgacaactactacgcctcattgcacggctcgctgagcggctcctactacttccacaaaagaaactataacgatgtgaccacacgcgtggcagccggcggcggcttccgcaacaacaaaattgacctcgaaatcaccccgttcgtgcaaaaacgcctctacggacgcggcagcaacggcgacaacaaactgcatgcgtattccaacagcgccggcttgagcgcctccaactcctactggataaaccccaaatggcgcctgaacaccaacgccgaattcagctatgacaaatacgtcagaacctatgactacctggacggcaagcgcatcagcctgagtaacaccctgacgtacacacccaaccaaaaacaatactggttcgccgggcttgacctcagccacaaaggcgcacgcagcgccagcgatggctatgaccgcttcaacacccgtcttggctggggacaggaatggggcaaaggcatctccacccgcctgatgggcagctacggcaagcgctacgccaaaggcgtggatttcttcaacattgaccgcgaagacaaagaatacaacgccaacctgtccgtctggcaccgtggcatccacttcttcggcatcaccccgcgcctcgtcttctcgtacagcaaaattgacagcaataaccgcttctatagctacgacgccagcaaaatctatatggacttcaccaagaccttctag

SEQ ID NO: 160 - protein, 523 aa, C. valvarum
MPRFHRQHRNLKMTTKTTITLQLTLASGILFAAMPAVAQNAPPPSRALPVDIDRGNERLSEDDVGKNVRLPQVPAVKPAAPTTLPSDAQAAKEDVVYTPEELANNPEQLEKLLVEAIRLNEVEGLKVLLPLYAKVDASRRDDSLIDWGNAIIAMNEGRTAEAVTLYRKLIANLPDNRMLRFQTALALYRNNELLAAKEQLQKLRSGDVSEADRKTLDEFIAAIDRRDSWSFSGSLSYIHDNNVNNVAPKGTRFRLSNGRSLESNRDQEKANGISYNLDADKKWSITDNYYASLHGSLSGSYYFHKRNYNDVTTRVAAGGGFRNNKIDLEITPFVQKRLYGRGSNGDNKLHAYSNSAGLSASNSYWINPKWRLNTNAEFSYDKYVRTYDYLDGKRISLSNTLTYTPNQKQYWFAGLDLSHKGARSASDGYDRFNTRLGWGQEWGKGISTRLMGSYGKRYAKGVDFFNIDREDKEYNANLSVWHRGIHFFGITPRLVFSYSKIDSNNRFYSYDASKIYMDFTKTF

SEQ ID NO: 161 - DNA, 1347 bp, Caulobacter sp. AP07
ttgagactcggcggtcgggcggccttcgccgccctggccgccgcgatcgtcctggcgcccggcccagcccgggcccaatccgaagaggcgcgggaggccggcgcgggcgtcgtgacgctctccggcgaccaggccttcgcgacggcgctgcaactgttcatccgggccggcgattatcgccaggcgctcgacctgatcgacacccgccccgacctggctgaccgggccgatgtcgtgcgcctgcgggcccagttgatggcgctgaccggtcgcgagcccgaggccctggcccttctggaagggcatctgacccgcgacgcggccgacgccctggcccgcttccaggtcgccgaactgcacttcgccgccgggcgcgacgtctcggccgccttggcctatcgcctgtccctggccggcgccctggacccgggacgggcccgcatcgccaatcttcgcctggagcagatccagcagcgtcggcgctggcgcttctgggcgggggcgtcggtcgcccccgacagcaacgtcaacggcgcgaccaacgcctcgcggatcgagctgttcggtctgccgttcgagctggacgacaaggcccgccgccgcagcggcgtcacggtctcggcccagggcggggtggagcggcgctttcggctggacgggcggagggcggtgcgcgcggccctggtcggagcggtgaccgacgctcccggcggcgacttcgacgacgccttcctgtcgttgcgcgccgggcccgaatggacgctgtcaccccgcgcccaggtcaccctgcaggcggcggtcaacggccgctggtacggcggcgcgctgctggagaccagccggggcctgagggtcgagggcgagctgtcgacccgcgacaacatccgctgggtgggtgcggcgcgcttcgacctggtcgatgcgcggatcaacgacggtcgcgacggcgaactctacgggctggagctggcgcggacccggtatctggggccaacctcgctgtggcgggccagcggttcgctgacggcgcgcgaggctcggtcgtcgaccgaggcctatgaccaggtccagctggcggcggggcgcctgtatcccctgccgttcaccaccctggcctatgtcgagccctatgtgatgcatcgacggttcgacggcctggcgccggcgttcggaaagcggcggatcgacagcgagtatggcgtggtcacccggctttccaagcgcgactggacgctgaagggcgctttcccgtttgtcgcgctgtcgatggcccgcaacgactcgacgatcgtcctcaacagcttcacccggcgtcgggtcgaggtcggcttgacgcgcgagttctag

SEQ ID NO: 162 - protein, 448 aa, Caulobacter sp. AP07
MRLGGRAAFAALAAAIVLAPGPARAQSEEAREAGAGVVTLSGDQAFATALQLFIRAGDYRQALDLIDTRPDLADRADVVRLRAQLMALTGREPEALALLEGHLTRDAADALARFQVAELHFAAGRDVSAALAYRLSLAGALDPGRARIANLRLEQIQQRRRWRFWAGASVAPDSNVNGATNASRIELFGLPFELDDKARRRSGVTVSAQGGVERRFRLDGRRAVRAALVGAVTDAPGGDFDDAFLSLRAGPEWTLSPRAQVTLQAAVNGRWYGGALLETSRGLRVEGELSTRDNIRWVGAARFDLVDARINDGRDGELYGLELARTRYLGPTSLWRASGSLTAREARSSTEAYDQVQLAAGRLYPLPFTTLAYVEPYVMHRRFDGLAPAFGKRRIDSEYGVVTRLSKRDWTLKGAFPFVALSMARNDSTIVLNSFTRRRVEVGLTREF

SEQ ID NO: 163 - DNA, 1485 bp, Caulobacter sp. AP07
atgacccgccccaaatgtttcccgatccgcatcgccgccggctgcgcggccttggccctgctggccctggccggagcggcgcgggcccaaagcgacgacgacacccgtctgcgcctgaaccaggatctgtcgcgcaaggcggcggagcgtgaggccaagactctggaagaggcctcgcccgccgtgctggtgatcgacggtcaggcctacgccgtgggtcccggcgccgacgatgtgggcaaggcgctgtatctgtcgctggcgcgtcgccagtggccagacgctcgccggttcctgaaagcctatctcgcccttcccgagcgcgaccccatgctggtgcgctacgcccagggcctgctggcccgccaggacggcgacctgcgcgccgccgaacgggcgttgcgcgagttgctgacgctgaaaccggacttcatgccgggccggatcgaactggcccgggtgttgttcgagaaccagcacgaccgcgaggccctgtccgccttccaggcgatcctggccgatctgccgaccagcgagccgagtggggcgggcgtgcgccgcagcgtggagggctttgtcgccgcgttgcgccagcgtggcgcctggcgcggttcgctggcccttggaccgggctacaacagcaacatcaaccaggcctccggcagctatgcctgcctgctgcccggtcccgacgggctctgcttcttcgaccgcaagacccccgatcccctcggggcggcgagcgtcagtttcgaagccgccctcaatcgccgcatgccgctgcggggatccagcgggctgagcttgcgggccttggcctatggcgagctctatcccgaagagggcgcctacagccaggcgaccctgatcgcccaggcgggctttgactatcgcaccgcgggcttggccctaggggtggctccgtcgctcgatatcgggaccctgggggcccaacgactctacgatgcgcccggcgtccatatcgagctcagccgcgccttcggcccatcgaccctgatcaagttggagggcgactataaagtcctgcgctatcgtcaggccgccttcgccccgctcgacggggcgcaggcctcgctgttcctgaccgccttgcgcggcctcaagcacggctggacggtgttcggcggcttcgacctcgcggacaaggacgccgaccagccggtcaacgcctatcgacaggcaggcttgcggctgggcgctgtcacgccgacgttcgcgggcctcaacgccaacgtcttcgcctcggtgcgccgcaagcgttgggatgccgtcaacgagaccttggaggcccgccgccgcgacgacgagcaagctgtcaccgcgatcgtccgcgcgccgcgcctgaagatggtcggcctgacgcccagcctgacggtgcaatacgccaaggtcgccagcagcatcgactggctgttctcctacgagaaggtggcggcgagcctgaaacttgagcgggtgttttga

SEQ ID NO: 164 - protein, 494 aa, Caulobacter sp. AP07
MTRPKCFPIRIAAGCAALALLALAGAARAQSDDDTRLRLNQDLSRKAAEREAKTLEEASPAVLVIDGQAYAVGPGADDVGKALYLSLARRQWPDARRFLKAYLALPERDPMLVRYAQGLLARQDGDLRAAERALRELLTLKPDFMPGRIELARVLFENQHDREALSAFQAILADLPTSEPSGAGVRRSVEGFVAALRQRGAWRGSLALGPGYNSNINQASGSYACLLPGPDGLCFFDRKTPDPLGAASVSFEAALNRRMPLRGSSGLSLRALAYGELYPEEGAYSQATLIAQAGFDYRTAGLALGVAPSLDIGTLGAQRLYDAPGVHIELSRAFGPSTLIKLEGDYKVLRYRQAAFAPLDGAQASLFLTALRGLKHGWTVFGGFDLADKDADQPVNAYRQAGLRLGAVTPTFAGLNANVFASVRRKRWDAVNETLEARRRDDEQAVTAIVRAPRLKMVGLTPSLTVQYAKVASSIDWLFSYEKVAASLKLERVF

SEQ ID NO: 165 - DNA, 1383 bp, D. alkaliphilus
atgtttagacgattccccaggcgcaagacccaaaggcaagctcaggtgggcggttttatgatgaaaaggcaacaagttggtccctgttcggcagccgcgattttgctggccctggtgctcttcttcggttctttgccggcggcggcagacccggtgctctccgggcgccagatgctggccgagcagcgctatgacgaggcctacgagttactgctgacggccttccgggccgaccccggccatcccgaaatcaattttcttttgggccgcgccgcctttgagtcgggccgcaccgaagaggcggtgatggcctacgaacgggtgctgctgcataatccggaggccaaccgggccaagctggagttggcccgctcctacctgcgcctgggctcccgggagctggcccgccagtattttcacgaggtgctggccaccaacccgccggagccggtctggcaaaacatccagcgttttctggcggccatggatgcggcggaaaaaaagcatttcatcaacggcctggtcaccctgggggtggggtatgacgacaacgtcaacaccttcccggccaacgatacggtgcgcttcaacggttggcaggtggacttgaaaggggaggaaaagagcaactggctgctcaacaccaacctggtcctcaaccatatctaccgcgcccgctataacagcccctggaactggaaaaccaccttcaccaactacaacgccttccacgaaagcgtcaacgacatggacctcaacctctttgccttgagcaccggccccacctggcgccgcgaccgtttgctgctgcaggcggcggtgggttacacccatgtcgacctgggttttgatcgctacctgggcatgctcggcttatctgccggcggcacctggctgctctcgcccaactgggcgctcaacggtggcctggagtggcgggaccgggactttcataaaaacgacgaccgggactccaccaacctgctggttaccctggggccggtattcagccacggcgacaaccgggtcggcctgaccttgggctatgaaaccaacgacgccgacaccgaccattattcctacgaccgctggcggctgggcctgcgttacgatcgccagttgcccaacgattttgccgcctttgccgcggtgcgctaccaggaaaccgactacgatgacgacgagccgttgttcaataaggcccgcgaagatgaaacgatcttttatcaactcgggctctccagagtgttctggcgggcggcagacagccggcgcagcctcaccggccagatcagctacagctataccgacgccgactccaatatcgagttgtacgaatacaccaaaagcgtggccaatttggccctgacctataccttttag

SEQ ID NO: 166 - protein, 460 aa, D. alkaliphilus
MFRRFPRRKTQRQAQVGGFMMKRQQVGPCSAAAILLALVLFFGSLPAAADPVLSGRQMLAEQRYDEAYELLLTAFRADPGHPEINFLLGRAAFESGRTEEAVMAYERVLLHNPEANRAKLELARSYLRLGSRELARQYFHEVLATNPPEPVWQNIQRFLAAMDAAEKKHFINGLVTLGVGYDDNVNTFPANDTVRFNGWQVDLKGEEKSNWLLNTNLVLNHIYRARYNSPWNWKTTFTNYNAFHESVNDMDLNLFALSTGPTWRRDRLLLQAAVGYTHVDLGFDRYLGMLGLSAGGTWLLSPNWALNGGLEWRDRDFHKNDDRDSTNLLVTLGPVFSHGDNRVGLTLGYETNDADTDHYSYDRWRLGLRYDRQLPNDFAAFAAVRYQETDYDDDEPLFNKAREDETIFYQLGLSRVFWRAADSRRSLTGQISYSYTDADSNIELYEYTKSVANLALTYTF

SEQ ID NO: 167 - DNA, 1329 bp, D. inopinatus
gtgatcgtcctcgtactgttaggctgtatctgtatgttgccttgcaacaacgcgcaagcgcagacaactgcggagaatatgcatatcaaggcagacaatacaaaagccgcggcattgatgcgggaagggaatttgggcgaagcgcgtgacatcttgttctcacgatatgaagacgactcttttgacaatcagtcgcttttcttgctcggtatggtgtccggcaaaatggggaatctcgatcagagcgaaaagtactatcgcgaattgctcgagcgcgaccccaaagcacaacgtgttcgccttgaactggccagtgtgctttatgccatggggcagtatgagaaagcgcaagctgaactcctccgggtcaaagaagccaaccctccggagaatgttgggctgaatatcgacaagtttttggaagccattgataagtccaagccaaaggcatggcgggttcgtccgtcaattggttttatgtatgattccaatgtgacccgctcgacgttcgatgacacggttcaactcatggaccaacaatttcatttgtccgaccgggcgcgcgcgcaggcagactgggccatggtgtatggtctggaagcagattactttcatttttttaccccgcaaagtgcattgcaatttcaatttcgcgggtcgtacaccgattattcctatgtggattggtttgatacggcggacttgagcgcttctcttggtcccacgttccaagttggacgttggatcgtttcactccctgctgtgggaacgtatctcaaatatggatcggaagatggagattttgcaaaatactatacggtaagtgtcgggttcgctccacaggtccggtatcagttgacggactcctgggaagtcgggatgaatctcgcgtattttttcaagaattattatgatgacgatcgatactctaatttgtttattgtgaatccctatcttcgcttttatccgaacgctgtgtcgtatgctcagctcggcgggtacttcatgcgtgaggatcaaaattgggatatttacagtaacgatgcatacggcattcaggcgacgtactttcgcagcttttttaatgattttaatatattttgtacgggaatattggggcagaccttttacagcggatatcgtactctctatggtgaaacacagcaggataccttgcttatggggcgcgcgtcattgagttataatatcgacgcattgtgggggcttactccggaactgagttatatctatacaaagaactggagcaacatcgatatgttttcctacgaccgtcatcaagtcatgtttagcctgtcaaaaacgttctga

SEQ ID NO: 168 - protein, 452 aa, D. inopinatus
MSWIRKRSIFVIVLVLLGCICMLPCNNAQAQTTAENMHIKADNTKAAALMREGNLGEARDILFSRYEDDSFDNQSLFLLGMVSGKMGNLDQSEKYYRELLERDPKAQRVRLELASVLYAMGQYEKAQAELLRVKEANPPENVGLNIDKFLEAIDKSKPKAWRVRPSIGFMYDSNVTRSTFDDTVQLMDQQFHLSDRARAQADWAMVYGLEADYFHFFTPQSALQFQFRGSYTDYSYVDWFDTADLSASLGPTFQVGRWIVSLPAVGTYLKYGSEDGDFAKYYTVSVGFAPQVRYQLTDSWEVGMNLAYFFKNYYDDDRYSNLFIVNPYLRFYPNAVSYAQLGGYFMREDQNWDIYSNDAYGIQATYFRSFFNDFNIFCTGILGQTFYSGYRTLYGETQQDTLLMGRASLSYNIDALWGLTPELSYIYTKNWSNIDMFSYDRHQVMFSLSKTF

SEQ ID NO: 169 - DNA, 1452 bp, D. nodosus
atgaatttattgtcaaaaatggtgatcagtccggcattattgatcgcgtttcatgcattttcagcggatatgacgattaaaccgcccgttagcgataaacataacgtcgtcgttcccgatcaacaagtaaaattgcctacggctgctcctttatccgatgccgaattggaaaaattgcctgccgcttattggcgggaaaatccgagcgcattggaaagcgttttgtcgaaatacgtggttatgggagatgccgaaggtttaaagaaatatttgccgtattaccgcgatgtgcccaatcgcgatccttctttgattgaatggggcgatgccattattgccgcgcgcgccggcgattttaaaactgctattcgtttataccgcaaaatcaattcattattgccaaacgtcacgctggtgcgttttcaattagcaatggcgttatatgccgataaacaatacgttgccgccgaacacgaattggaaaaattgcgcgccgaacaattgcccgagcaatacgcgcaagctgttgatcatgttttaaaaatgattcaccggcaggaacaatgggatttttatgcatcagcgacttattcttatgataaaaacgtcaacgaagcgccgccggtcggcacaaaaatggtttttcctaacggcagctccattaccagtcaacaagaaccgcgcagcgccaacggcgttgaatttgatttttctgccgataaacgctggaatttgcgcggtaattattttgcggcattgcatttgagcacttttggcaaattgtattgggacgaaaaaacctctaacgatttaagcagccgcatcggaatcggcggcggttatagcaacgcggtaaccgaaattgaattatcgccgtttttctcgcatcgttggtacgtcaaccgcgacgataacaacagcaattttgatcactacaatacgggttacggcttgcgtttgagcggctcgcaatggttatcaacaaaatttaaatatcaaggcgcgttggaatggactcaaaatcgttaccgcagcgattatcgtcatttaaacggcaatgattatttgatgtcgcacacgttaatgtatttgcccgctgcgcgctattattggttcggcggcatcgattacagcattcgcgatgtcgaatcaaaaaccaactcttatgaccgctggggcgcacgtttgggctggggacaagaatggggcaaaggttttgcaacgcgcaccacaatcggctacggcagaaaaacctttgatgacgtggatttctttaatatcaaacaaaaaaataacgaatacagcgcctctgttagcctgtggaatcgtaatttttatttcggcggtatcacgccgcgcttgacgtggtcttatcgcaaagttgacggcaatcacccgttttataattacgataaacaaaacgtggttgtggaattttctaaaacgttttaa

SEQ ID NO: 170 - protein, 483 aa, D. nodosus
MNLLSKMVISPALLIAFHAFSADMTIKPPVSDKHNVVVPDQQVKLPTAAPLSDAELEKLPAAYWRENPSALESVLSKYVVMGDAEGLKKYLPYYRDVPNRDPSLIEWGDAIIAARAGDFKTAIRLYRKINSLLPNVTLVRFQLAMALYADKQYVAAEHELEKLRAEQLPEQYAQAVDHVLKMIHRQEQWDFYASATYSYDKNVNEAPPVGTKMVFPNGSSITSQQEPRSANGVEFDFSADKRWNLRGNYFAALHLSTFGKLYWDEKTSNDLSSRIGIGGGYSNAVTEIELSPFFSHRWYVNRDDNNSNFDHYNTGYGLRLSGSQWLSTKFKYQGALEWTQNRYRSDYRHLNGNDYLMSHTLMYLPAARYYWFGGIDYSIRDVESKTNSYDRWGARLGWGQEWGKGFATRTTIGYGRKTFDDVDFFNIKQKNNEYSASVSLWNRNFYFGGITPRLTWSYRKVDGNHPFYNYDKQNVVVEFSKTF

SEQ ID NO: 171 - DNA, 1437 bp, D. nodosus
atgaagcaatatagtgggttattactgggttttttgactttatcggtgtgcgcacaagaagcttatcaagtgcaagttgccaaagaagtcaatccaacattacgtctgcccgaagttaaaattccgtgggagatgttgtcatcattattgtcggaagaacaagatgcaccgttggatttatcggaggatcctcaagcggtggcgcgctctttggacaatgccgttgcgcacggtcgtttagagcaaataaaagttttattgccgcattataaaaagttccccgaacacgaacgcaacgagcaattaattcgttttgcggaagcggcattggcgcaatctgtaggaaatgtgaaacaaaccattgagttatatcgcgaaatgattgctaatgatcccaatttgccgcccgtacgattgcagctcgcattggcattgatgcgcgatcggcaagatgcggctgcaaaagatcaattggaacgtttgcgtagcgaagatttgccggaagagattgctgccgtggtcgattcagctttagcggctcttagagaacggcaggcgtggtcgtttggcgtcagcggatattatgtgcacgattctaatatcaatcaggcgccggatattcgttctcgcgaaacggatcagtgcccttttgctgaaaaatgtacgattacttttccggaaaaagaaaatgccgatggactttatttgcggcttaatgcggatcggcgtttgcccattaaaaataattggtacgccaattttgaaggcagcgcacacgctaattggtattggaatacggatcaatatgatgatattcaagtgcgtttgggatcgggcgtgggttatgaaaatgcgcgctttgatgcgagcgtattgccgtttgttagtcaacgtttttatgctggaaaaaaatatgcgcacgccgctggcgccacggtcagcatgaattattggatgacaccaaaatggcggttatcgggtatttatgaaggcgaatatgcacaacacgatcatcattcatggttagacggtcaacggcattatcaagcgcttaatctcttatatttggcgcattctggacgctattttttcggcggcgttaatcattattatcaagacgcccaagatgatgcggatcgcttttttcggtacggcgtcaacgctggttggatagaggattggtcgggtggactttctacgcggttaagcgcttccgttgggaaacgtctttatcaaggtgctgatttaatggcaaatattaagcgtaacgatacggaatataataccggcgtgcaactttggtaccgcgattggcatttttggggcattacgccaaaattgtcactagaatggaataaaaccaatagtaatcatttctattacgatcgaaaaaatggcacgggtcgcgcttatattgaattgagcaaaacattttaa

SEQ ID NO: 172 - protein, 478 aa, D. nodosus
MKQYSGLLLGFLTLSVCAQEAYQVQVAKEVNPTLRLPEVKIPWEMLSSLLSEEQDAPLDLSEDPQAVARSLDNAVAHGRLEQIKVLLPHYKKFPEHERNEQLIRFAEAALAQSVGNVKQTIELYREMIANDPNLPPVRLQLALALMRDRQDAAAKDQLERLRSEDLPEEIAAVVDSALAALRERQAWSFGVSGYYVHDSNINQAPDIRSRETDQCPFAEKCTITFPEKENADGLYLRLNADRRLPIKNNWYANFEGSAHANWYWNTDQYDDIQVRLGSGVGYENARFDASVLPFVSQRFYAGKKYAHAAGATVSMNYWMTPKWRLSGIYEGEYAQHDHHSWLDGQRHYQALNLLYLAHSGRYFFGGVNHYYQDAQDDADRFFRYGVNAGWIEDWSGGLSTRLSASVGKRLYQGADLMANIKRNDTEYNTGVQLWYRDWHFWGITPKLSLEWNKTNSNHFYYDRKNGTGRAYIELSKTF

SEQ ID NO: 173 - DNA, 1305 bp, D. shibae
atgcgggcccgtccggggcggcgaccggcgacctggtggcggtgcggcccgcggatcctgtgcagggtcgcggggctgtgcgcttgcctggcagtcgcggcacccgtggcggcgcaacccgccctgcccggcgccgcgcgcagcaccctgcccgtcgatggcgcggcgatcgaggcgcggttcctgcgcgggcttgccctgctgaacggcggtcaggcggcggcggcgatcccgctctttctcgacattctggcgggagacccgaccctggtgcgggtccggctggaactggcgcgggcctatttcgccgccgaacagtggagccgggcgcgggaggagttcttcgccgtcctctccaccgacctgccggagccggcgcggctgcgggtgctgggcttcatccgggcgatcgacgcgcggcgggggttcgactgggacctgtccatcggcctggtcaccctgggcgaacggcggcgctatgacagcgacacggtggatctggagatcgcgggcacggtgctgcccttcaccctggagcgggacaccgacaccgagccggggctgcgggtgacgggggcggcgcgctggcggcaggggctgacgcgggtcggggcgacggagcttgtggggttcgcgggggtcgatctcgatgcgctggaggggccaggggcgcggtacgacgacatcacaatcggcgcgcggacgggggtgcggtttctgggcgcgcggagctcggtggtggccgcggccttcgggcggagccgccacgtggcgggagacgggttcgaggaccgcttcggcctggatctgtccttcgagcggcgcagtgcgggcggcgtgtcggtctttggcgcggcgtcctgggcggtgctggacagcgcaatttcggacgaccgggacgggcacgcggtggcggcccagcttggcctgcggcgctccgtgggcgggcgcgcgacgctcggcgcggcgctgcgggtggaagagaaccgggtggcgttcgacctggaggattaccgcgacaccgagctgcgggtcttcggcagctatgacgcggtccgggggatcacgttgcggcccgagctgtccctgcggtaccgggatttccgcgaccccagccccctgttcaccgccagcccgaacgagcgcgcggtgcaggtcgcgctgacggtgcagaaatccgacctgttcctgggtgacgggttctcgccctttgcacgggtcagccatacccgcagccggtcggacatcgacgcctacagctataccgagagcgaagttcagatcgggctggagcggcggttctga

SEQ ID NO: 174 - protein, 434 aa, D. shibae
MRARPGRRPATWWRCGPRILCRVAGLCACLAVAAPVAAQPALPGAARSTLPVDGAAIEARFLRGLALLNGGQAAAAIPLFLDILAGDPTLVRVRLELARAYFAAEQWSRAREEFFAVLSTDLPEPARLRVLGFIRAIDARRGFDWDLSIGLVTLGERRRYDSDTVDLEIAGTVLPFTLERDTDTEPGLRVTGAARWRQGLTRVGATELVGFAGVDLDALEGPGARYDDITIGARTGVRFLGARSSVVAAAFGRSRHVAGDGFEDRFGLDLSFERRSAGGVSVFGAASWAVLDSAISDDRDGHAVAAQLGLRRSVGGRATLGAALRVEENRVAFDLEDYRDTELRVFGSYDAVRGITLRPELSLRYRDFRDPSPLFTASPNERAVQVALTVQKSDLFLGDGFSPFARVSHTRSRSDIDAYSYTESEVQIGLERRF

SEQ ID NO: 175 - DNA, 1458 bp, Escherichia coli
atgaaattactctgctcactgctgctgacctgcctgtgcgctggctcgcttacgccggcgtttgccgctactaacgatgacgaccgcgggcttcgcctgtggatgaaggatcggctggcctatcaggaaacaagcgacaccgcaccggataaagaccagccgctgctgcaggacccgctgtcgctcagcctggaggggaaaacctacagcctgaacaacaatgcgcaggacctgggcctggccatctacctcgccatcagccatcgccagtttcgcgatgccctgcgcctgttgccggcctatgaacggctggcggatcacgatccgctgctggtgctgttcgcccgggcggaatacgcccgcgatcgcggccactacgccgaggccattgatgactaccggcagatcctccatcgctcaccggatttcctgcgcgtgcggctggagctggcgcgcaccctgtttgaagataatcagaaccgcgaagcgctggcgatgtttaaccgcattctcgccgaccgcggggcagagttgcccgcggggacgatcgccaccatcaggcagtttaccggcgccattgaaacgcgtacggcctggaccggcagtctctcgctgggctacgtctggaactccaatattaatcagaccccggatcgcgacgctccgtggctttccggcggcggactgtggcgccgtgaggatcctaaaagcagcggcggcgtgtcttacgacgccagtctgagcaaaatttttccgctggccgggcaccacgctctgcagctgaagggcaccacctacggtgaccgctacccgcatcaggcacagttcagtgagaacacctccaccctggcgctgctctggcagtacagcaacgccaccacccgcgcggccatcgggccggtggtggagatgaagctatccgacgaacagaggctctataccggacgcgggctgcggctggatggcgactaccgttttaccccacgcctgatgctgagcctgaatgccgactaccagaagctgacctacaaaaaagagtatgaaacctccgacggcgagcgcggcaacctctatctgaccgggatttatggcctgacgccggcgacctcactgttcattggcgcagacggtacccgcgtcaccacccaggtgcgcagcgatgactactaccagaccggcctgcgcgcgggtgtgttcagcgccattaccccggatatcaacctgatggtgatggcgacgcgccgcaacagccgctttgccgcgtttaacaccttcgtcggcgatgaacgccgcgatcgcgaacagctgtatatggcgcgggtgagcctgcccggctaccagatgctgacgctgacgccctttgccagctaccgcttccgtaaaaaccacagctctgccgacgggctttattcgtaccgccagcatgaagtggtgatgggatttgaaactaacttttga

SEQ ID NO: 176 - protein, 485 aa, Escherichia coli
MKLLCSLLLTCLCAGSLTPAFAATNDDDRGLRLWMKDRLAYQETSDTAPDKDQPLLQDPLSLSLEGKTYSLNNNAQDLGLAIYLAISHRQFRDALRLLPAYERLADHDPLLVLFARAEYARDRGHYAEAIDDYRQILHRSPDFLRVRLELARTLFEDNQNREALAMFNRILADRGAELPAGTIATIRQFTGAIETRTAWTGSLSLGYVWNSNINQTPDRDAPWLSGGGLWRREDPKSSGGVSYDASLSKIFPLAGHHALQLKGTTYGDRYPHQAQFSENTSTLALLWQYSNATTRAAIGPVVEMKLSDEQRLYTGRGLRLDGDYRFTPRLMLSLNADYQKLTYKKEYETSDGERGNLYLTGIYGLTPATSLFIGADGTRVTTQVRSDDYYQTGLRAGVFSAITPDINLMVMATRRNSRFAAFNTFVGDERRDREQLYMARVSLPGYQMLTLTPFASYRFRKNHSSADGLYSYRQHEVVMGFETNF

SEQ ID NO: 177 - DNA, 1440 bp, E. corrodens
atgagaatacagaacaagccgcggctggccgcctgcctgctgctgttgccttttcaggtagccttggccgatctgccggcagacaggctggaaaccgagccggataccggcttcgacatcacgccagcggccgcgccgcaggtggaggctgcgcccgctcctgccaacactcagcccgacaaacgcctgcaaatgagccgcgaagaattgctccagcgccccgagctgctgcaacaggcgctcagctatgccgtgctcacccacaatgccgacggcgcggcactgctgctgccgatttatctcgaattgcccgggccgcacgatgcgctgctggtggctttggcacaggcgctgattgcccgtgccaagggcgactaccagcgcgccatcggcctctaccgcgccgtgctggccgccgatcccgatatcccgccggtgcgcctttcgctggcgcaaagtctgtttgaaaatcgtgccgacaaagatgcgcggcaagagttcgaacatttccgccaaactcccaatctcgcgcccgagctgcaacagcttgccgggcaatacctggaagccctgcgcaaacgcgaccgctggagcttcggcggcagcgtaaacttcatcagcgacagcaatgtaaacaacgccggacgcgagcgcgaaatccgcacctcgcgcggcgtatggacactgcccgagcccgagtccgcccaaggcttcgcctaccgcctcaacgccgatcgcgactggaacgtacacggcaacctctactggcggctcagcctcgacgactacggcaaattctattggaataaccacaaatacgacgaccaaatcgcccgcctcagcagcggccccgcctacaaaaccgcccgtgccgaagccgccgttaccccttattacgagcgccgctggtatggcacacacaaatactcgcgcgaagtcggcgtgcgcgccgaatggcaatattggctcaccccgcgccataaaatattgagcgcgcttgaaatcggcgagcagcgccacgaccgccgccgctggctcgacggcgacagctacaccgcttccggcacttggctcttcgtgcgcagccccacccaatatttcagcttcggcctcgactggctgcgcaaaaccgccgaagacaacagcgaatcctacacccgcaaaggcctgcgcttgggctggacgcagcaatggggctgggggctcaccacctccgcccaaatcagcgccggccaccgcagctacgacgcccccgacctgttccgcatcacccgccgcgaccacgagcttgccgccagcctggtgctctcccaccgcaaactgcaattcgccggcatcaccccgcagctggtgggcacctggcagcgggtaaacagcaaccacttcttctatccctaccgcaaaggcaacgtgtttatccagtttgggcgttcgttctaa

SEQ ID NO: 178 - protein, 479 aa, E. corrodens
MRIQNKPRLAACLLLLPFQVALADLPADRLETEPDTGFDITPAAAPQVEAAPAPANTQPDKRLQMSREELLQRPELLQQALSYAVLTHNADGAALLLPIYLELPGPHDALLVALAQALIARAKGDYQRAIGLYRAVLAADPDIPPVRLSLAQSLFENRADKDARQEFEHFRQTPNLAPELQQLAGQYLEALRKRDRWSFGGSVNFISDSNVNNAGREREIRTSRGVWTLPEPESAQGFAYRLNADRDWNVHGNLYWRLSLDDYGKFYWNNHKYDDQIARLSSGPAYKTARAEAAVTPYYERRWYGTHKYSREVGVRAEWQYWLTPRHKILSALEIGEQRHDRRRWLDGDSYTASGTWLFVRSPTQYFSFGLDWLRKTAEDNSESYTRKGLRLGWTQQWGWGLTTSAQISAGHRSYDAPDLFRITRRDHELAASLVLSHRKLQFAGITPQLVGTWQRVNSNHFFYPYRKGNVFIQFGRSF

SEQ ID NO: 179 - DNA, 1539 bp, E. corrodens
atgcagatgaaaacgagtgcgcttctgattatttttacgttgtgtacagcacaacacagttggggcaatacaacgccggaacaggatcagaagcgttttttgcaaacggggcagcagcagtggctgcgacagttggaaaacaacgcgcaaatgcctgcagccaaagatgggcagcaggccgcgccggtgcttacacagcaggatttgctggcacggccacagctcttggcgcggatgctggtgcaggtgttaaacggcccgccgcagccggaattgttggcggatttgacttcactgtatgcgcaaacgccgcagccagacatggtgttgctgcggcgtgcacaaggcatgcaggctagatatgcgggcgactatgcgcgcgcagtgcaaatttatcgggaactggtggcagaagagccgcaggatgtgcgcatccgcctggatttggcggccatgctggcagaagataagcaatggcgcgaatcggcacagctatttgaaactgtgcggagcgagccggaagtgccggcggaagtgcagaataatgtgcagcattatctgaaccatattgccaaacagcagcagtggcagtggagcggcgggctttcgccctcgtttgataacaatgtgaacaacgcaccgccgccgcattgcagcccgttcggttgcagccgcgaacgcgcagaagatgctgtgggcgtggcttacagcctgggtgtggcgaaaaaccagccgctggccgggcatcataacttgcacgtgcagctggatgtgagcggcaccaattattattggagcaacaaatcggcctacgacagcgcctacggccgtttgggtgcgggctggctctggcaggatgcgcggcagcggctgttggtgatgccgttttaccaattccagctcagcggcaccgacaactgggatggccgcaaaccgcaaaacaaccacacgctgaaaatgcacatgtgggcgcacgcccccgggctgcgcacggaatacagccgcctgctcaccccgcgctggcagctgcacaccgcactggatgcctaccgccagcactatcggatggataccaaagcagaaatgtataacggctggtatttgggcgaaagcatttccctggcttggcgtgccacagcgcgcaacacgctgtatgccgggctgaatttcaaccagatgctgccggaacaatccaccctgagcggcaagccgaacaatgccgcctaccgccgccacggcatcggcgccggttggattcatgattgggacgcactgggcggcctctccacccggctcaacgtatccttcgccgaacggcgtttccgcggcaccgcactaaacatcacaccgcaaggcttcccgcgcgaacaacgccgcgaccacgaaatccaatactccgcttcgctgtggcacagaaactggaccatcctcggcctcaccccgaagctgaatttctcctggcaacacacccgcagcagccatgtgtgggcagaacgcaaaagccggcaagtgtttgtggaattggaaaagcagttttaa

SEQ ID NO: 180 - protein, 512 aa, E. corrodens
MQMKTSALLIIFTLCTAQHSWGNTTPEQDQKRFLQTGQQQWLRQLENNAQMPAAKDGQQAAPVLTQQDLLARPQLLARMLVQVLNGPPQPELLADLTSLYAQTPQPDMVLLRRAQGMQARYAGDYARAVQIYRELVAEEPQDVRIRLDLAAMLAEDKQWRESAQLFETVRSEPEVPAEVQNNVQHYLNHIAKQQQWQWSGGLSPSFDNNVNNAPPPHCSPFGCSRERAEDAVGVAYSLGVAKNQPLAGHHNLHVQLDVSGTNYYWSNKSAYDSAYGRLGAGWLWQDARQRLLVMPFYQFQLSGTDNWDGRKPQNNHTLKMHMWAHAPGLRTEYSRLLTPRWQLHTALDAYRQHYRMDTKAEMYNGWYLGESISLAWRATARNTLYAGLNFNQMLPEQSTLSGKPNNAAYRRHGIGAGWIHDWDALGGLSTRLNVSFAERRFRGTALNITPQGFPREQRRDHEIQYSASLWHRNWTILGLTPKLNFSWQHTRSSHVWAERKSRQVFVELEKQF

SEQ ID NO: 181 - DNA, 1371 bp, E. hoshinae
atgctgattaaaatagaatcccccctttcacagctaggctcagctattattttaagcgtattaatgataagcacagcggatgccgctagcacttctcaatcggtaaaaaatactgtcatcctttctccagcagaattaacagcacaccctcagattattttccaaggtatgatccaggcggtgatgaaatcagacgccgccgctgtcaagatcttgctgccgctttatcaggcgcaggcagggtacgatccaaccctggccacctggggtaaggctattttagccaaagaggacggtaactatcgcgatgccattcgttattaccgccgcgtcatcgccaaagagccacagctaaatattgcccgactacagctggctatcgcactgtttcaaaataaagaccgcgcctctgcgctactgcaattcaataaactgcgggccaatagcaacggcgaaagagtcaatgagatagtggatagctatatcaaggcgatacagcagaaagacagttggtcattcaacgtaggggttaactatattaatgaaagtaacattaataatgcgccgggagataaggtaaaaattggtcagtggcaggcggaaaaacggcaaagcggacagggtttctcttactatcttagcggcagtaagacctggtcattaccggagggggtgttcagcgagatccgtacgctgacctacgggaagtatttcaccaacaatcatcgctacgatcaggcgacggcccgcctgagcctaggtttgggcctacgcgacatcgacgcctccctgctgctgctgccctttatagagcgcgaatgggcatcggataatcaggcgccctcccttgctagcgagggaacctcgccggggctacgaattgaatcaaaataccgtctaagcccacgctggaaaatcgacgttgaggctgagaaaagtcacactacaaataaacgccgcacccagcgtgacagtaaaaaccatctactgtcagcgacgctctattatttccccagccccgaacaattttggtttttgggcggtgactaccaacgtgaaaacgttgcacgcaagagtttagcttttcagaaaataaagtggcggggcggctggggaaatgagtggccgggcggcatatccagcatcatgcagataaactacgccaataagttttacgatagcgctgacttcttcggaattcagcaaagaaataaagagtacggcgccctgataacgctctggcaccgtgacatttattactttggtatcacgccaaagatcaacctgtcatattttaaaagtgacagcaatcatccattttacgaatacgataaaaaaatggtctttctaacctttagtaagtttttttaa

SEQ ID NO: 182 - protein, 456 aa, E. hoshinae
MLIKIESPLSQLGSAIILSVLMISTADAASTSQSVKNTVILSPAELTAHPQIIFQGMIQAVMKSDAAAVKILLPLYQAQAGYDPTLATWGKAILAKEDGNYRDAIRYYRRVIAKEPQLNIARLQLAIALFQNKDRASALLQFNKLRANSNGERVNEIVDSYIKAIQQKDSWSFNVGVNYINESNINNAPGDKVKIGQWQAEKRQSGQGFSYYLSGSKTWSLPEGVFSEIRTLTYGKYFTNNHRYDQATARLSLGLGLRDIDASLLLLPFIEREWASDNQAPSLASEGTSPGLRIESKYRLSPRWKIDVEAEKSHTTNKRRTQRDSKNHLLSATLYYFPSPEQFWFLGGDYQRENVARKSLAFQKIKWRGGWGNEWPGGISSIMQINYANKFYDSADFFGIQQRNKEYGALITLWHRDIYYFGITPKINLSYFKSDSNHPFYEYDKKMVFLTFSKFF

SEQ ID NO: 183 - DNA, 1371 bp, E. piscicida
atgttgattaaaatagaaccgccacttttacagataggctctgctattctgttaagcatattaacgctgaccgcagcggatgctgccggtgcacctcaatcggtaaaagacacttttatcctctctcaagatgaattaaaaacacacccccggattatttttcagggaatgatccaggcggtaatcaaatcagacgtcgccgctgtcaagatcttgctgccgctttatcaggagcagctaggacacgatccaaatctggtcgcatggggaaaggctattttagcaaaagaggacggtaactatcgccaggcgattcgctattatcgccgcgttatcgccgaggaaccacagctaaatattgcccgactgcagctggctatcgcgctgtttcagaataaagaccgcgcctctgcgctactgcagttcaataagctgcgggccaatagcaacggcgaaagaatcaatgagatattggacagctatatcagagcaatacaggggaaagacagctggtcattcaatgtaggcgttaactatattaatgagagcaatattaataatgcgccaggcgataacgtgaaaattggtcagtggcaggctgaaaaacggcaaagtggacagggcttctcctactaccttagcggcagcaaaacctggtcattgccagagggactgtttagcgagatccgcacgctggcctacgggaaatacttcaccaacaatcatcgctacgatcaggcgacggcccgtctgagcgcaggcctgggcctacgcaacatcgatgcctccctgctgctattgccctttatcgagcgcgaatgggcatcggataatcaggcgccctccctttctagcgagggaacatcgccggggctgcgtattgagacagaataccgtctgaacccacgctggaaaatcgacgttgacggtgagaaaagccacactaaaaataaacaccacgcacagcgtgacagtaaaaatcatctgctgtcagcaacgctctattatttttccagccccgagcaattttggttttggggcagtgactaccaccgtgaaaacgttgaacgtaagagcttagcctttcagaaaataaaatggcgggcgggctgggggaatgagtggccgggcggcgtatccagcatcattcagataaattacgccaacaagttttacgatagcagcgacttcttcgggattcagcaacggaataaagagtacggcgcactgataaccctctggcatcgtgatatttattactttggtatcacgccaaaaatcaacctgtcatattttaaaagtgacagcaatcatccattttacgaatacgataagaaaatgatcttcctgacctttagtaagcttttttaa

SEQ ID NO: 184 - protein, 456 aa, E. piscicida
MLIKIEPPLLQIGSAILLSILTLTAADAAGAPQSVKDTFILSQDELKTHPRIIFQGMIQAVIKSDVAAVKILLPLYQEQLGHDPNLVAWGKAILAKEDGNYRQAIRYYRRVIAEEPQLNIARLQLAIALFQNKDRASALLQFNKLRANSNGERINEILDSYIRAIQGKDSWSFNVGVNYINESNINNAPGDNVKIGQWQAEKRQSGQGFSYYLSGSKTWSLPEGLFSEIRTLAYGKYFTNNHRYDQATARLSAGLGLRNIDASLLLLPFIEREWASDNQAPSLSSEGTSPGLRIETEYRLNPRWKIDVDGEKSHTKNKHHAQRDSKNHLLSATLYYFSSPEQFWFWGSDYHRENVERKSLAFQKIKWRAGWGNEWPGGVSSIIQINYANKFYDSSDFFGIQQRNKEYGALITLWHRDIYYFGITPKINLSYFKSDSNHPFYEYDKKMIFLTFSKLF

SEQ ID NO: 185 - DNA, 1371 bp, E. tarda
atgctgattaaaatagaaccgccgcttttacagataggttccgctattctgttaagcgtattaaccatgagcgcagcagatgctgctagcgcgcctcaagcggtaaaaaatacccttgtcctttctcaagaagcattaaaaacgcaccctcagattattttccaaggcatgatccaggcggtgataaaatcagacgccgccgccgtcaagatcttgctgcctctttatcaggcgcaggcaggatacgatccgaccctggccgcatggggcaaggctattttagccaaagaggacggtaactatcgcgacgccattcgttattaccgccgcgtcatcgccaaggaaccacagctaaatattgcccgactgcagctggctatcgcgctgtttcagaataaagaccgcgcctctgcgctactgcaattcaataagctgcgggctaatagcaacggcgaaagagtcaatgagatagtggatggctatatcagggcaatacagcggaaagacagctggtcattcaacgtaggcgttaactatattaatgagagtaacattaataatgcgccagacgctaacgtaaaaattggtcagtggcaggctgagaaacggcaaagcggacagggcttttcctactatcttagtggtagcaaaacctggtcattgccggaggggctgttcagcgaggtccgtacgctggcctacgggaagtacttcaccaacaatcatcgctacgatcaggcaacggcccgtctgagcgcaggtctgggcctacgcgatatcaacgcctccctgctgctcttgccctttatagagcgcgaatgggcatcggataatcaggcgccctccctttctagcgaaggagcatcgccggggctgcgtattgagacagaataccgtctgagccctcgctggaaaatcgatgttgacgctgagaaaagtcacactacgaataaacatcacgcccaacgcgacagcaaaaatcatctgctgtctgcgacactctattattttcccagccccgagcaattttggttttggggtagtgactaccagcgtgaaaacgttgagcgtaagagcatagcctttcagaaaataaagtggcgaggcggctggggaaatgagtggccgggcggcatatccagcatcatgcagataaactacgccaataagttttacgatagcgctgacttcttcggaattcagcaaagaaataaagagtacggcgccctgataacgctctggcaccgtgacatttattactttggtatcacgccaaaaatcaacctgtcatattttaaaagtgacagcaatcatccattttatgaatacgataaaaaaatggtcttcctgacctttagcaagcttttttaa

SEQ ID NO: 186 - protein, 456 aa, F. aurantia
MLIKIEPPLLQIGSAILLSVLTMSAADAASAPQAVKNTLVLSQEALKTHPQIIFQGMIQAVIKSDAAAVKILLPLYQAQAGYDPTLAAWGKAILAKEDGNYRDAIRYYRRVIAKEPQLNIARLQLAIALFQNKDRASALLQFNKLRANSNGERVNEIVDGYIRAIQRKDSWSFNVGVNYINESNINNAPDANVKIGQWQAEKRQSGQGFSYYLSGSKTWSLPEGLFSEVRTLAYGKYFTNNHRYDQATARLSAGLGLRDINASLLLLPFIEREWASDNQAPSLSSEGASPGLRIETEYRLSPRWKIDVDAEKSHTTNKHHAQRDSKNHLLSATLYYFPSPEQFWFWGSDYQRENVERKSIAFQKIKWRGGWGNEWPGGISSIMQINYANKFYDSADFFGIQQRNKEYGALITLWHRDIYYFGITPKINLSYFKSDSNHPFYEYDKKMVFLTFSKLF

SEQ ID NO: 187 - DNA, 1500 bp, F. aurantia
atgcgcaaacgtgcaagatctgcaggaccgggacaggaagcggctcgccgcctcctgtcccttatcgtgtggctgacgatgctgatggttatcccggaactgggccaggcccagaccgtcgaggacaaccagctgcggctgaaccagtccggccagcgccggtccgccagccgagatcgtgccttgctggaggatacggataccctgaccgtggatggtcgtgactacagcgtggcacataccgtcagcgagataggccaggccatctatatcgcactgggccggcagcaatggcctgacgtgcagcgctttctgcggcgctatgccagcatgcccggcgctgacccgatgctgctgcattatgctcgcggcgggctggcccgccacaagggacatctgcgtcaggcagagcgcgaataccgcgccctgctggccttgcagccggattttctgcccggccagctggaattggcccgggtcctgttcgagaaccagcgggatcaggcagccgcaacccagttccggcagattgccgccgcgctgccctcaacggccaaggccgacggcatccgccataccgtacagctgtttctgcaggccttgcgacgacgacacagctggcaaggcagcttcgctctaggccccggctacaatgacaatatcaaccaggcccaggccagccagacctgcctgtggatcgacggcgcgggcaactgcatcatccatcggcgcatgcccgccgccatcgcagccaccggtctggatatcgaggccagcctgtttcgccagcaaccgttgtcgggtccgcacaatatctacttgcgcagcctgctgatgggcagcctgtatcccggccatacccgctaccatcagctgaacagcctcaaccagatcggctaccagtaccgcaacggccacgacacctggatgctggcccccggcttcgatgccggcagctatggcagcggtctgctctatcgggcctggggcctgcatggcgaatggagccacggctttgcttcgtcctggctgctgaagctggaagccgatcacaagcgtttccgttatcccatgttcggctaccgtgatttcgacggccatctggaggacggctttgtcaccgtgtcgcgcgctgtcggccagcactggctgctgctgggtgggctggacctggtcgacaagcaggcacgcgacccggctcagggtttcatgcagcgtggcgcacgactgggtgccgtctacagtctggagaaccagttcagcctgtatctgatggcttccgtccgcgagcgcgactacgccgccttcaatcccatgctggcacaacgacgccatgatctggaacggaatctgatcctgatcgccagcctgcctcgctggtcgctgttcgggatctatcccagcctggtcgcccagatcagcgagatacgcagcaatgtggactggctgtacagctatcaacgacgccagatcagtctgcgtctgcaacgaccgttttga

SEQ ID NO: 188 - protein, 499 aa, F. aurantia
MRKRARSAGPGQEAARRLLSLIVWLTMLMVIPELGQAQTVEDNQLRLNQSGQRRSASRDRALLEDTDTLTVDGRDYSVAHTVSEIGQAIYIALGRQQWPDVQRFLRRYASMPGADPMLLHYARGGLARHKGHLRQAEREYRALLALQPDFLPGQLELARVLFENQRDQAAATQFRQIAAALPSTAKADGIRHTVQLFLQALRRRHSWQGSFALGPGYNDNINQAQASQTCLWIDGAGNCIIHRRMPAAIAATGLDIEASLFRQQPLSGPHNIYLRSLLMGSLYPGHTRYHQLNSLNQIGYQYRNGHDTWMLAPGFDAGSYGSGLLYRAWGLHGEWSHGFASSWLLKLEADHKRFRYPMFGYRDFDGHLEDGFVTVSRAVGQHWLLLGGLDLVDKQARDPAQGFMQRGARLGAVYSLENQFSLYLMASVRERDYAAFNPMLAQRRHDLERNLILIASLPRWSLFGIYPSLVAQISEIRSNVDWLYSYQRRQISLRLQRPF

SEQ ID NO: 189 - DNA, 1494 bp, G. anatis
atgcctaatttagtaaaaaaaacagcaaagtttgccttttcacctatggtagtagggttatttccgtttgtttttataacaaatagtttagctgctcctgttacttccccgacaaccgttattgatgttaagactgagccaaaagaatatattaatgtggcacaaccggatttacgttctacgccaaaagtgcaaccaaaagagacagctacgaaacaagatgacagccgtgaaattacggatgaagaattgcaacaacgccctgaacttgcacgtaggttattaaattatgttattgatacacaacgttggcatttattgcctgatcttttagagatttataagaaaactcgtgatcctgatcctattctcattgattatgctcaagcgacactttatcgtgtacaaggtaatttaacaggagcaattagcttatatcgccatattttggcagacaatccaaactttggacctgttcgtttcgcattagcacaagccttattcgaggattaccaaacagaagcagcagaagatcaatttaataaattacgagcaagctcaaaccttccgccagagattatggctgtttctgagcaatatttaatggcaattaagcaacaatcagcatggtcgtttagtggctctttatcttatttacaagatgataatgtgaataatgcagcaaaagataaagtggtttatattggtaatgtacctttccaaaaaagtgaagaatctttgccacaatcagcccatggtttgcaatatagtatcaatttgagcaaaaaatttaatttaattggtcgccattcgctttatttagaaaataatttgtatggaaaaagtttttgggataaccacgaatatgacgatattctgaaccgtactacagtgggttatcaatatcaggatataaagaatcgttttgctattcttcctttctatgcttatcgctggttcggtggtgagaaatatagccgtaattatggtactcgttttgagtatgaacgttggttatcaccaaaatggcaaaccagttcagccattgaattaagtaaaacgaaatataaagaaaatagtgatgcggatagtaatagtcaactttattctacaaccttacttcacttatttaatgcgaaaacctatttttatgggggagtagattatcaacgtgaaaaagctcaaaatcgaatgttttcttccgatcgaatgggatttcgtttggggtggggacaagaatggaaatggggactttctacccgtttacaatttggcatagaacatcgtaactttaaagaaaagaacctattttttaataaggttcgtaaagataaagaatataatagtgtctttactatatggaatcgtgaatggcatttatggggaattactccaaaacttaattttagttggatgagagtagatagtaatattccagcactgtatagttatgataaaaatagagtttttttaaattttgagaaaacattctaa

SEQ ID NO: 190 - protein, 497 aa, G. anatis
MPNLVKKTAKFAFSPMVVGLFPFVFITNSLAAPVTSPTTVIDVKTEPKEYINVAQPDLRSTPKVQPKETATKQDDSREITDEELQQRPELARRLLNYVIDTQRWHLLPDLLEIYKKTRDPDPILIDYAQATLYRVQGNLTGAISLYRHILADNPNFGPVRFALAQALFEDYQTEAAEDQFNKLRASSNLPPEIMAVSEQYLMAIKQQSAWSFSGSLSYLQDDNVNNAAKDKVVYIGNVPFQKSEESLPQSAHGLQYSINLSKKFNLIGRHSLYLENNLYGKSFWDNHEYDDILNRTTVGYQYQDIKNRFAILPFYAYRWFGGEKYSRNYGTRFEYERWLSPKWQTSSAIELSKTKYKENSDADSNSQLYSTTLLHLFNAKTYFYGGVDYQREKAQNRMFSSDRMGFRLGWGQEWKWGLSTRLQFGIEHRNFKEKNLFFNKVRKDKEYNSVFTIWNREWHLWGITPKLNFSWMRVDSNIPALYSYDKNRVFLNFEKTF

SEQ ID NO: 191 - DNA, 1419 bp, G. anatis
atgcgattttcaataccagtttttaccttatctttgttatttgttagcaacacactgtttgccgcacaagaattatcacaacccttgccaatcagcaatattgctcaacctgaacaaccaccacaacaaatacaaaatacgccaacagaaaacggaaattggcaacaggttgatttctctactaatatacaaaatcagctgaatctcgcattgcgtaaacgtaatgcagcagaaatcgcctattggctcaaacactatcaagcaaacacgccacagcaacaatttctgcgcgattatgctcagggcgtattagcacagctcaacggggattatacgcaggcagttacttactatcgccaattattagctcaatcaccagatctaaacccgatccgccttgagcttgcacgctcactgtttgccttaaaacaagacgataatgcgcgcactcaatttgaaaaattactttccgcaccggatttaccttccccattacaacgagaaatcggtgcttatctcaataccttgcaacaacgcaatcaatgggaaattcaattgagcggatattatgtacgtgatacaaatgtgaataacgccaatgatacaaaacaaattgaaggtatcgctcagctctataaaaaagatgattggttaccacaaactgcgcacggcattgcttacagcttacaagcaagacgagatttcaacctttggcaagcctattatctacatttaaacgcggaattatttggcaaaacctattgggataatcacgattatgatgatctctacatccgtacttatgtaggaataaagcacaaaagccaacgccaaacttgggcgcttttgcctttttacgaacggcgcttttacggcaatcatcgctatcaagaaggtacaggattacgcttagaatatcaacgttggctatcgccaaattggcaaatcagctcagcattggaatacactcgcacgcgttatgatgaaattgcgagcctaaatgggaataatcgtttgtggtcaaacaccctaatttggcttactagcccacgacaattttttattttaggggctgattatcaacaagaacgcacgcaagtaaaacgctaccaaaaccatacacaaaccttacgcttaggctggggacgagaatggcagctgggcatttcaagccgaattcaatttagcatagccaaacgacattataaagacaaagcaaaaattgcgattttctcactaggtaaaattcgccaagatcacatttatcgtgcggagattttactatggaaacgagattggcactggcttggcatcacccctaaattacaattccaatggagaaaacagcacagcaacttaccatcactttataattatcagaacagaagtattaatgtgatttttgagaaaagcttttaa

SEQ ID NO: 192 - protein, 472 aa, G. anatis
MRFSIPVFTLSLLFVSNTLFAAQELSQPLPISNIAQPEQPPQQIQNTPTENGNWQQVDFSTNIQNQLNLALRKRNAAEIAYWLKHYQANTPQQQFLRDYAQGVLAQLNGDYTQAVTYYRQLLAQSPDLNPIRLELARSLFALKQDDNARTQFEKLLSAPDLPSPLQREIGAYLNTLQQRNQWEIQLSGYYVRDTNVNNANDTKQIEGIAQLYKKDDWLPQTAHGIAYSLQARRDFNLWQAYYLHLNAELFGKTYWDNHDYDDLYIRTYVGIKHKSQRQTWALLPFYERRFYGNHRYQEGTGLRLEYQRWLSPNWQISSALEYTRTRYDEIASLNGNNRLWSNTLIWLTSPRQFFILGADYQQERTQVKRYQNHTQTLRLGWGREWQLGISSRIQFSIAKRHYKDKAKIAIFSLGKIRQDHIYRAEILLWKRDWHWLGITPKLQFQWRKQHSNLPSLYNYQNRSINVIFEKSF

SEQ ID NO: 193 - DNA, 1398 bp, G. anatis
atgaaaaaattattgatcaccagttttgtcatttttgcatattcattaaatgctgaatctttattacggcaagatccaattgatttttcgcaagaaggtgatatttcattacctacacagctaaaacccaatgctaattatcaaaaaatgccaatgatttctatggcattgccaattgattcacaaattcaatctgcgattttacagcaacaatgggcattattacctagattattaaggcaatatcaacaacagggacattatgatcctgcgttgtatcattatgcgttagctgcctattatttcaatacgttacagtatgataaagctattctgcattatcaaacattattagatttacaccctgaagtcatttaccctcgctttgatatggcagtgattttttttgaaaattatcaatatttacaagccaagcaacaatttgaacgtttaatgcttaaagcagatggcaaattaaaaacattgattgaagcctatttgcaagaaattaaacatcgtcagcaatggcagccctatgtgaattttcaatatgtgaaaacagataatgtgaataatgcttcttctgaacgagagataactattaatggtaaaccgcttgtaaaagacgaagaatcacttcctcaatcagcacaaggtgttcggtatgcgtttgaacttgaacgaataaaaaatataacaggcaatcatttttggcaaacgacattaggatataacggtgtttactattgggataatcaatattataacgaacaaactttacatttttcattgggttatatgtggcgagatgctcagtttgttggaaaaattattccttttgttgaacagaattggtttggcgttcatcgttacaatcatcaatttggcgtaaagttgtttagccaaattcaactttctgaacactggctttggcagaatcgtttggcaaatatgagaaaacattatgctgatactagtttggcagatcgttataatggtaatgaaaacactgtttcgaccactataatttggcaagataatacacattggcaatcttggcttaatttagaattggtgtccgatcgtttaaaagagaagtcttcatcatcgttgaaatgggcaagtggttttggtattacttattatcaaaaacaatggggtacacaaatcaatgttcgttatatagatcgtaattttgctgatcatcactatttaatgcatttaaaacggcacgacagagaatatcaactaaatggtgcgatttggtatcaaaaattatcttggagaggcttcttgcctaaattacatatccgctatcaacggataaacagcaatattcctgcactttatagccgaaaaaatcaggaactcttttttacgatagagaagcaattttag

SEQ ID NO: 194 - protein, 465 aa, G. anatis
MKKLLITSFVIFAYSLNAESLLRQDPIDFSQEGDISLPTQLKPNANYQKMPMISMALPIDSQIQSAILQQQWALLPRLLRQYQQQGHYDPALYHYALAAYYFNTLQYDKAILHYQTLLDLHPEVIYPRFDMAVIFFENYQYLQAKQQFERLMLKADGKLKTLIEAYLQEIKHRQQWQPYVNFQYVKTDNVNNASSEREITINGKPLVKDEESLPQSAQGVRYAFELERIKNITGNHFWQTTLGYNGVYYWDNQYYNEQTLHFSLGYMWRDAQFVGKIIPFVEQNWFGVHRYNHQFGVKLFSQIQLSEHWLWQNRLANMRKHYADTSLADRYNGNENTVSTTIIWQDNTHWQSWLNLELVSDRLKEKSSSSLKWASGFGITYYQKQWGTQINVRYIDRNFADHHYLMHLKRHDREYQLNGAIWYQKLSWRGFLPKLHIRYQRINSNIPALYSRKNQELFFTIEKQF

SEQ ID NO: 195 - DNA, 1446 bp, H. aegyptius
atgaaaaatggcgtaaaacaaatttctctcttatcattaataggcttatcattaccgaatgtagcttgggcagatgttgcacgtcctaaaaatgatacattgacaaatacgattcaaagtgcggaattaaaaacctcctctttttcttctatgcctaagaaagaaataccaaataggcatattatttctctttccaaaagccaattagcacaacatccaagacttgttttgcgtgggttaattcttgctttatatcaaaataacactcaggcagttcaactgttattaccactatataaacaatttcctcagcaagataatttcttactcacttgggcaaaggctattgaagcgcgtgaacaaggcgatttaactcaatctattgcttattatcgtgaattattcgctctagacgcatctttactacctttgcgttatcaattagctcaagccctattttttaactatgaaaatgaatctgccaaaattcaatttgaaaaattacgtacagaggtagatgatgaaaaatttttaggtgttattgatcagtatcttttaacactaaatcagcggaatcaatggatatggcaagtaggcttaaattttttaaatgatgataatttgaataacgctccaaaaagtggcacaaaaattggtaattggaccgcttgggaaaaagaaagtgggaagggggtagggtattctttatcagtagaaaaaaaatggccgtgggcagatcatttttttagtaaaactatgtttaatgggaatggaaaatattattgggataataaaaaatacaatgaggctacttttcgtataggtggtggtttaggttatcaaactgccttagttgaagtctcgttgtttccttttcaagaaaaacgctggtatgcaggcggtagctctggaacgaatacaatgaagcaatatgcggataaattgggtattcgtttagaaaacgtagattggctaagtaaaacttggcaaatttctaccgcacttgagtatggaaaatctcgttataaaacccgaaaacatttagatggtgattattatttcatttcatcaacactattttatttacctaaaagcactcaattttggtttgttggcatggattttcatcgagaaaatacacaagcattagataatgcttatcaacaaaagacattgagatttggttgggggcaggattggtcttatggtatttcatcacgttttacttttagttatgccaaccgagtgtatagagagaaagatttgattgggatacagcaaaaaaatcgtgaatacacaaccacaattactttatggcatcgaaatatacattttatgggattaacacctaaattatcgtgggattatcaaaaatccactagtaatcatgctttttatcgttatgataaaaatagaatttatctcgaaattggaaaaatattttaa

SEQ ID NO: 196 - protein, 481 aa, H. aegyptius
MKNGVKQISLLSLIGLSLPNVAWADVARPKNDTLTNTIQSAELKTSSFSSMPKKEIPNRHIISLSKSQLAQHPRLVLRGLILALYQNNTQAVQLLLPLYKQFPQQDNFLLTWAKAIEAREQGDLTQSIAYYRELFALDASLLPLRYQLAQALFFNYENESAKIQFEKLRTEVDDEKFLGVIDQYLLTLNQRNQWIWQVGLNFLNDDNLNNAPKSGTKIGNWTAWEKESGKGVGYSLSVEKKWPWADHFFSKTMFNGNGKYYWDNKKYNEATFRIGGGLGYQTALVEVSLFPFQEKRWYAGGSSGTNTMKQYADKLGIRLENVDWLSKTWQISTALEYGKSRYKTRKHLDGDYYFISSTLFYLPKSTQFWFVGMDFHRENTQALDNAYQQKTLRFGWGQDWSYGISSRFTFSYANRVYREKDLIGIQQKNREYTTTITLWHRNIHFMGLTPKLSWDYQKSTSNHAFYRYDKNRIYLEIGKIF

SEQ ID NO: 197 - DNA, 1542 bp, H. haemolyticus
ttggcggatttttgtccgccatttttcaacttattgtttgtttataaatatttacttaaagttactcattttatgaaaagtattgctctcttttttactgcacttttccccgctcttgctttagcagaaacaacggcaccagatattcgtcaaacaccaattaaaaccgaacttgaacctcaaattaatgtcgccaaacttgaaaaacgcgaacaaaatttaccgcacttaggtacagaacaagcagaacaaattgaaattacccttgagcaacttaaacaaaaccccgctttaacccacgaattattaagccgtgccatttacgcacgcaatccaggaatgataaaaaaattgctggaaatttaccgcacttttccaaatcgtgacccgattatggaacgctttgcggaaggaaaattggctgcgataacggaaaactatactgtagctattgataaatatcgcgaaattttagccaaaaatccaaatttaaaccctgtacgaattgaactggctatcgctttattcaatcaaaaacaagacggtgctgctaaagaccaatttgaaaaagcacaaaccgcagaggatttaccgcctcaagttaagcgtttaatggatgcttatttagaggctttaaaagaacgtgatagctggaatgtggatttttcttttaattatgtacgtgataccaatgtcaacaatgtcggcgagggaaaaacggtcgtattaaataatggtggcaccttaacacgttcggaatcgatgatgccacaaacagcacacggcttagcgtactcactggatatttccagagattttaatttatggggttctcattacctcacggtgggcaatgagtttgggggaaagagctactgggataatcataaatttgatgatatttccaaccgcacttttgttggctatgcacataaaaccgcaaagcaaaatttccgtattaaacccttttatgaaaaacgttggtatggcggcgaaagttaccgttggtctaatggggcaagggtggaattttctcgctggttaagtccaaactggcaactttttacggcgggagagttttcaaaacaacgttatttagacagtacatcacaaaacggtaataacaaactgatttccgcaaccttactgtgggcaagaacaccgaaacagtttttctacctcggttctgattttatggcagaaagaacgaaggttcgtcaatatggttcagacagtaaaagcttacgtttaggttgggggcaagaatggaattggggcatttcctcacgtctcggcttatccataatgaaacgtgaatttaaagatattgccaaacttggtaatctcaatttgttttcttttggaaaacgtcgagaagataaaatttacggcataaatttatccctatggaaacgcgattggcatatttggggaattacaccaaaactccaattaagctggcgtaaacaagatagcaatatcccagaaatgtattcttatacacagaagaatgtgaatatgttgtttgaaaagacattctga

SEQ ID NO: 198 - protein, 513 aa, H. haemolyticus
MADFCPPFFNLLFVYKYLLKVTHFMKSIALFFTALFPALALAETTAPDIRQTPIKTELEPQINVAKLEKREQNLPHLGTEQAEQIEITLEQLKQNPALTHELLSRAIYARNPGMIKKLLEIYRTFPNRDPIMERFAEGKLAAITENYTVAIDKYREILAKNPNLNPVRIELAIALFNQKQDGAAKDQFEKAQTAEDLPPQVKRLMDAYLEALKERDSWNVDFSFNYVRDTNVNNVGEGKTVVLNNGGTLTRSESMMPQTAHGLAYSLDISRDFNLWGSHYLTVGNEFGGKSYWDNHKFDDISNRTFVGYAHKTAKQNFRIKPFYEKRWYGGESYRWSNGARVEFSRWLSPNWQLFTAGEFSKQRYLDSTSQNGNNKLISATLLWARTPKQFFYLGSDFMAERTKVRQYGSDSKSLRLGWGQEWNWGISSRLGLSIMKREFKDIAKLGNLNLFSFGKRREDKIYGINLSLWKRDWHIWGITPKLQLSWRKQDSNIPEMYSYTQKNVNMLFEKTF

SEQ ID NO: 199 - DNA, 1446 bp, H. influenzae
atgagtatacaaactaaatttattttatttctcagctcatcattatttcttaccccatattcggttgctacagaaaaatctccacaaccacatgatgggcgtttagatgagcagctacatttggccaaaccaaatttaccacaaaaaccaaccgcacttttgaccaataataatccatcaaagttatctattacaaaagaagaattagccaaacacccagacttgattattcgcggtcttatccctgccgtattacaaaataatggtgaggcagtacaacttttattaccgctatatcagcctttacctaaaaaagatccgttcttgttagaatgggctgaagcgattgatttacgagaaaaaggacatttttctgattctgttaaagcctaccgacacttattttcacaaaaaactgatcttttacctttgcgctatcaattagctcaagccttgtttctaaataatgataatgaggcggcaaaagatcaatttcaaaaattaagagcagagcaagtttcccctgattctgtaaaaataattgaacaatatctttctgccttaaatcaacgagatcaatggaaaatccaaggtggatttagttttttaaatgaaagtaatattaataatgcgccaaaagccggcacaaaaattggcaactggacagcttgggaaaaagaaagtgccagaggattttcgtattttgggaatgctgaaaaaaaatggtcattacctcacaaccactttacaaaattgtccttggaaggtagtgggaaatattattgggataacaagaaatataatgaatttaacgcgagagctggtgcaggtcttggataccaaactgcgcgatttgaagtctccttgatgccatttactgaaaaacgttggtatgtgggcggctcatcaggcggaaatgcgatgaaacaatactctaaaaattcaggtgctagattggatttatccaattggctaaatgaaaaatggcaaatttcgaccgcacttgagtatggtgaacaacgctatgaaactcgtaaacatctaaatggaaataactatctagcttccgctacgctactttacctggcgaaaagtggacagtattggtttggcggagctgattataatcgcgaaaacactcgagatttagataatgcttatcaacgaaaaaatgtccgattaggatggggacaagaatggaaagctggtatatcaactcgtttaatcctgaattatgcacgacgtgcctataaagaaaaagatcttatcggtattcgtcaaaaaaataaggaatatgcttcagtcttcactatctggcatagaaactttcatatttggggaattacaccgaaattatcttggtcgtatcaaaaggtaacaagtaatcatcctttttatgaatatgataaaaatcgaatttacgtagaaatcagcaaaacattttga

SEQ ID NO: 200 - protein, 481 aa, H. influenzae
MSIQTKFILFLSSSLFLTPYSVATEKSPQPHDGRLDEQLHLAKPNLPQKPTALLTNNNPSKLSITKEELAKHPDLIIRGLIPAVLQNNGEAVQLLLPLYQPLPKKDPFLLEWAEAIDLREKGHFSDSVKAYRHLFSQKTDLLPLRYQLAQALFLNNDNEAAKDQFQKLRAEQVSPDSVKIIEQYLSALNQRDQWKIQGGFSFLNESNINNAPKAGTKIGNWTAWEKESARGFSYFGNAEKKWSLPHNHFTKLSLEGSGKYYWDNKKYNEFNARAGAGLGYQTARFEVSLMPFTEKRWYVGGSSGGNAMKQYSKNSGARLDLSNWLNEKWQISTALEYGEQRYETRKHLNGNNYLASATLLYLAKSGQYWFGGADYNRENTRDLDNAYQRKNVRLGWGQEWKAGISTRLILNYARRAYKEKDLIGIRQKNKEYASVFTIWHRNFHIWGITPKLSWSYQKVTSNHPFYEYDKNRIYVEISKTF

SEQ ID NO: 201 - DNA, 1461 bp, H. influenzae
atgaaaaatggcgtaaaacaaatttctttcttatcattaataggcttatcattaataggcttatcattaaccaatgtagcttgggcaaaagttgcacgtcctaaaaatgatacattgacaaatacaattcaaagtgcggaattaaaaacctcctctttttcttctatgcctaagaaagaaataccaaataggcatattatttctctttccaaaagccaattagcacaacatccaagacttgttttgcgtgggttaattcttgctttatatcaaaataacactcaggcagtgcaactgttattaccactatataaacaatttcctcagcaagataatttcttactcacttgggcaaaggctattgaagcgcgtgaacaaggcgatttaactcaatctattgcttattatcgtgaattattcgctcgagacgtatctttactacctttgcgttatcaattagctcaagccctattttttaactatgaaaatgaatctgccaaaattcaatttgaaaaattacgtacagaggtagatgatgaaaaatttttaggtgttattgatcagtatcttttaacactaaatcagcggaatcaatggatatggcaagtaggcttaaattttttaaatgatgataatttgaataacgctccaaaaagtggcacaaaaattggtaattggaccgcttgggaaaaagaaagtgggaagggggtagggtattctttatcagtagaaaaaaaatggccatgggcagatcatttttttagtaaaactatgtttaatgggaatggaaaatattattgggataataaaaaatacaatgaggctactttgcgtataggtggtggtttaggctatcaaactgccttagttgaagtctcgttgtttccttttcaagaaaaacgctggtatgcaggcggtagctctggaacgaatacaatgaagcaatatgcggataaattgggtattcgtttagaaaacgtagattggctaagtaaaacttggcaaatttctaccgcacttgagtatggaaaatctcgttataaaatccgaaaacatttagatggtaattattatttcatttcatcaacactattttatttacctaaaagcactcaattttggtttgttggcatggattttcatcgagaaaatacacaagcattagataatgcttatcaacaaaagacattgagatttggttgggggcaggattggtctcatggtatttcatcacgttttacttttagttatgccaaccgagtgtatagagagaaagatttgattgggatacagcaaaaaaatcgtgaatacacaaccacaattactttatggcatcgaaatatacattttatgggattaacacctaaattatcgtgggattatcaaaaatccactagtaatcatgctttttatcgttatgataaaaatagaatttatctcgaaattggaaaaatattttaa

SEQ ID NO: 202 - protein, 486 aa, H. influenzae
MKNGVKQISFLSLIGLSLIGLSLTNVAWAKVARPKNDTLTNTIQSAELKTSSFSSMPKKEIPNRHIISLSKSQLAQHPRLVLRGLILALYQNNTQAVQLLLPLYKQFPQQDNFLLTWAKAIEAREQGDLTQSIAYYRELFARDVSLLPLRYQLAQALFFNYENESAKIQFEKLRTEVDDEKFLGVIDQYLLTLNQRNQWIWQVGLNFLNDDNLNNAPKSGTKIGNWTAWEKESGKGVGYSLSVEKKWPWADHFFSKTMFNGNGKYYWDNKKYNEATLRIGGGLGYQTALVEVSLFPFQEKRWYAGGSSGTNTMKQYADKLGIRLENVDWLSKTWQISTALEYGKSRYKIRKHLDGNYYFISSTLFYLPKSTQFWFVGMDFHRENTQALDNAYQQKTLRFGWGQDWSHGISSRFTFSYANRVYREKDLIGIQQKNREYTTTITLWHRNIHFMGLTPKLSWDYQKSTSNHAFYRYDKNRIYLEIGKIF

SEQ ID NO: 203 - DNA, 1251 bp, H. influenzae
atgaaaaatataatagtctttttatcactatgtttaattagttctaatatttatagtgaaacgagagcaattaattataattcatctgatataaaacaaaatccagcaataatagaaatgttattgctggatgccattgatgaagacaatattaatggaatagaatcattattgatagattaccagagattacataatgctagacttgatctaattgctattgccaaatttaaaattggtcaataccagtttaataattatcaaaataataaatctttaaaaaattttcaattagctaaattaatatttaattttccgccacttcatttttacatcatagaacagtacctatccgttttaaaagcaagagaaagttggcaattttccttaggtgggaattatttacaaactaagaacgtgaataatacgtctaatgagcgacatattgaaaacacaggctttgtgaaaaatgaggatatgttgccacaatcggcacatggctttgcttattattttgatgctcagaaaaattggaacatagcaggttcgcattatctgcattttgcgaataacctatatggcaaaaattattggaataatcataattatgatgaaatcactaaccgcacttatttaggctatcaatatcaaaatgctaaatataaattggtattaaaaccgttttatgagcgtcaatggttgggcggtcatcgttataactgggcaaatggtgctagagcggaatatagtttaaatctttcaaaaaattggcagatttcaaccgcacttgaattaagccagctacgttattttacccaagcagatcgtaatggaacaattaagttagcttctgtaacctttatttggcagccatctgataaaggttattattacttaggttcggattttattcgcgaaaccacgcgtataaaacaatatagcaatgatatgaaagcattacgattaggttggcggcaaaattggggttatgcaattgcaagtcaaattaatggctctattgcgttgaaacagtataaggattttgcttctcttggtgggattttgccgttaaataaaattcgtcgagataaaatctattctctgaatttaactttatggaaacaagattggcagtatttaggttttacgccgaaagtgcaattccgttggaaaaaacaagaaagtaaccttccttcaatgttttcttattcagaaaaatatgtgcagatgttagtagaaaaggatttttaa

SEQ ID NO: 204 - protein, 416 aa, H. influenzae
MKNIIVFLSLCLISSNIYSETRAINYNSSDIKQNPAIIEMLLLDAIDEDNINGIESLLIDYQRLHNARLDLIAIAKFKIGQYQFNNYQNNKSLKNFQLAKLIFNFPPLHFYIIEQYLSVLKARESWQFSLGGNYLQTKNVNNTSNERHIENTGFVKNEDMLPQSAHGFAYYFDAQKNWNIAGSHYLHFANNLYGKNYWNNHNYDEITNRTYLGYQYQNAKYKLVLKPFYERQWLGGHRYNWANGARAEYSLNLSKNWQISTALELSQLRYFTQADRNGTIKLASVTFIWQPSDKGYYYLGSDFIRETTRIKQYSNDMKALRLGWRQNWGYAIASQINGSIALKQYKDFASLGGILPLNKIRRDKIYSLNLTLWKQDWQYLGFTPKVQFRWKKQESNLPSMFSYSEKYVQMLVEKDF

SEQ ID NO: 205 - DNA, 1464 bp, H. parahaemolyticus
atgaaactttcccactcaattgtatttgcaatctttggcctaaatctgacctctttcgcacaggcagaaatagtgcaaccgcaagaaaagaaaatggctgagcctaaaaatgatttaaccgaacgcttccaagtggctcaaccaaaacctaaaactcagcctgatacagaacaaacagaaacatcaggctcggtgtcgatgacaaaagaagaattagctcagcaccctgatttaatcgtacgaggtttaattccagctgtgttacaaaacaacgaacaagcggtcgaattattgttgccgatgtaccaaaacttgccaaagcaagatccattcttacgtgagtgggcagaagcgatttcggctaaagcacaaggcaattttagccttgcagtagaacgttaccgctcgctctttgcacaaaaatcggatattcctgctttgcgttatcagctcgctcaagccctctttttaaataacaataatgaggcagcaaaagatcaattccagaaattgcgtgcggaaaatttatcgcccgattcagtggcaattatcgaccaatatttgactgctttaaataaacgtgatcagtggaaatttagcggtggaatgagcttccttaacgagacgaatatcaacaatgcacctaaagcgggcacgagagtaggcggttgggaagcatggaaaaaagagagtgcacagggcttttcttactacttcaacactgagaaaaaatggtcgttgccaaatcagtttttcaccaaaatagcgttggatacttcgggaaaatattattgggataacaaaaaatataacgagcttaatgtgcggacaggtgttggcttaggctatcaaaccgcacgttttgaaattgctcttaccccctttaccgagaaacgttggtatgcgggtggttcatcgggcagtgaatcgcttaaacaatattcaaaaaactcaggtgtgcagcttgaaagcagttactggctgaatgaaaaatggcaactttcaaatgtattggaatatggtgaacaacgctacgactggcgtaagcacctaaacggcaacaactatttgtggtcaaacacgctcttatatgtgccaaaaagcgggcaatattggtttgcaggtttggattacaatcgtgaaaatactcgcgataaagacaatgcttaccaacgtactagtgcacgtttaggctgggggcaagaatggggctggggaatttctagccgcatctcgttttcttatgcgaagcgaacttatcaggcacatcctgctccagatttaatcggcaaaatacaaaaaaatgatgaatattcttctgctttaacgctctggcatcgtgacttgcatttctttggcgtgacaccaaaagtgacgtggcaatatcagaaagtaagcagtaaccacccattttatagctacgataaaaatcgggtttattttgagatgagtaaaacattttaa

SEQ ID NO: 206 - protein, 487 aa, H. parahaemolyticus
MKLSHSIVFAIFGLNLTSFAQAEIVQPQEKKMAEPKNDLTERFQVAQPKPKTQPDTEQTETSGSVSMTKEELAQHPDLIVRGLIPAVLQNNEQAVELLLPMYQNLPKQDPFLREWAEAISAKAQGNFSLAVERYRSLFAQKSDIPALRYQLAQALFLNNNNEAAKDQFQKLRAENLSPDSVAIIDQYLTALNKRDQWKFSGGMSFLNETNINNAPKAGTRVGGWEAWKKESAQGFSYYFNTEKKWSLPNQFFTKIALDTSGKYYWDNKKYNELNVRTGVGLGYQTARFEIALTPFTEKRWYAGGSSGSESLKQYSKNSGVQLESSYWLNEKWQLSNVLEYGEQRYDWRKHLNGNNYLWSNTLLYVPKSGQYWFAGLDYNRENTRDKDNAYQRTSARLGWGQEWGWGISSRISFSYAKRTYQAHPAPDLIGKIQKNDEYSSALTLWHRDLHFFGVTPKVTWQYQKVSSNHPFYSYDKNRVYFEMSKTF

SEQ ID NO: 207 - DNA, 1425 bp, H. parahaemolyticus
atgaaaaaactcgcaaactttcttatttttctaccgcttgcagttcaagcggaaacctttcacgcacctcaacctgttttctttgaaaacaatactttgcccaaacagactgaaccacaaataaaaacgcaactacaaacagaaaatccgcctgccccttcgtttgccctttctgatgcagacagcaccaaaaccaagctagagaagttgattaactatggtgtattaaaacagcaatggcatttgttgaagcagattctgccgttgtatcaacagcaggcggattatgatgaaacgctttatcgttacgcaatgggggcgatgttgcgggcggaaaaagaatatccacaggcaatttcgctttatcagcagattttagccgagaagccagagttagcttatccgcggtttgatttggggatgatgctgtttgagaataaacaatatcgccaagcaaaagcggagttggaacgtgctaagcccgaactttcaccacaaatgcagcaacttaccgaacattatattcaggcgatgatagagcggcaaagttggcagcctgatatggagctgcaatatacccaaaccgataacgtgaacaatgcttcttctcagcaagatattgtgttaggcgacttgcggtttaaaaaagatgcggaatcgctgccacaaaaagcccacggcttccgttatggtgtgggcgtgaaccgtgaattgaatgtgggcggcaaccattttgttaccacaaatggtcgctttagtggcgtgcattattgggataagcaagattatagcgaaaaatcactttatgcttcgcttggttatcgttaccgttcggcattgcaagcggtcggattttccccattttttgaacagaactggctcggttcaccacgttatagcaaaaattacggtgcagttgcagattttcgtcaagaattgaccgcttactgggcaatttcaggatctttttcgcatacgcaaaaacgctatgcacaagaaagcgtggctcgccgtcataatggttacttaaatggtgtttcattttcgttaagctaccaagccaagccgaattggttgctgtttggtggcatggaagacagtgttgatcgtagcaaagataaagcggaatcttcgcttcgccgtggggtgaatatcggttcagtgtgggaaatgaaggattttgtgagccgcgtgagcgtgcgttatgtaaaacgtgatttccaagcggaaaatttctatttcccaatgaaaaaacgccaagataaagaatacagttttaacgccaccatttggcataacaaactacaatggcaaggttttgtaccgaagctaaattatcgctaccgcaaaattgatagcaatattccagaattttattctagaaaaagtggcgagtggtttgtgtcagtagagaaagatttttag

SEQ ID NO: 208 - protein, 474 aa, H. parahaemolyticus
MKKLANFLIFLPLAVQAETFHAPQPVFFENNTLPKQTEPQIKTQLQTENPPAPSFALSDADSTKTKLEKLINYGVLKQQWHLLKQILPLYQQQADYDETLYRYAMGAMLRAEKEYPQAISLYQQILAEKPELAYPRFDLGMMLFENKQYRQAKAELERAKPELSPQMQQLTEHYIQAMIERQSWQPDMELQYTQTDNVNNASSQQDIVLGDLRFKKDAESLPQKAHGFRYGVGVNRELNVGGNHFVTTNGRFSGVHYWDKQDYSEKSLYASLGYRYRSALQAVGFSPFFEQNWLGSPRYSKNYGAVADFRQELTAYWAISGSFSHTQKRYAQESVARRHNGYLNGVSFSLSYQAKPNWLLFGGMEDSVDRSKDKAESSLRRGVNIGSVWEMKDFVSRVSVRYVKRDFQAENFYFPMKKRQDKEYSFNATIWHNKLQWQGFVPKLNYRYRKIDSNIPEFYSRKSGEWFVSVEKDF

SEQ ID NO: 209 - DNA, 1254 bp, H. parahaemolyticus
atgaaaaacacacttctttttattttagtctcaagtatttgttgcaatatttttgctaacgaaaaacaagaaaacacctattctatttccgatttagaaaaagatcctaaaacaaccgaaaaattactttcagatatgctaagtattgatcgaatggatttagtagatcgtttattaccgatttatcaaatttttccagaaaacaatccaagattggttaattacgccaaaataagacaagtaagattattattcttagattatcaaaataataatgccaaaaaggcttttcagttattgcaaatggaagaaaatttaaatcatgaagagcggtcgattattcaaaattatttgcaagcaattgaaaaccgagaacgttggcaattttctttaggtgggaattatttacaaactaagaatgtgaataatacatctaatgagcgacatatcgaaaacacgggttttgtgaaaaatgatgatatgttgccacaatcggcacacggctttgcttattattttgatgctcagaaaaattggaacatagcaggttcgcattatctgtattttacgaataatctatatggcaaaaattattgggataatcataattatgatgaaatcactaaccgcacttatttaggctatcaatatcaaaatgctaaatataaattggtattaaaaccgttttatgagcgacaatggttgggcggttatcggtataactgggcaaatggggcaagggcggaatatgggctgagttttgcaaaacattggcaaatttcgaccgcttttgagttcagtcagcctcgttatttcactcaacctgatcgcaatggtaacattaaactggcttccaccacgtttatttggcaacccaccgaaaaaggttattactatttaggtacggattttattcgagaaaccacacgtataaaacaatatagtaatgatatgaaagccttgagaataggttggaggcaaaattggggctatgtgattgctactcaagtcaatggttcaattgcgttaaaacaatataaagattttgcttctcttggtggaattttgccattaaataaaattcgtcgtgataaaatctattctctgaatttaactttatggaaacaagattggcagtatttaggttttacgccgaaagtgcaattccgttggaaaaaacaagaaagtaacattccttcaatgttttcttattcagaaaaatatgtgcagatgttggtggaaaaggatttttaa

SEQ ID NO: 210 - protein, 417 aa, H. parahaemolyticus
MKNTLLFILVSSICCNIFANEKQENTYSISDLEKDPKTTEKLLSDMLSIDRMDLVDRLLPIYQIFPENNPRLVNYAKIRQVRLLFLDYQNNNAKKAFQLLQMEENLNHEERSIIQNYLQAIENRERWQFSLGGNYLQTKNVNNTSNERHIENTGFVKNDDMLPQSAHGFAYYFDAQKNWNIAGSHYLYFTNNLYGKNYWDNHNYDEITNRTYLGYQYQNAKYKLVLKPFYERQWLGGYRYNWANGARAEYGLSFAKHWQISTAFEFSQPRYFTQPDRNGNIKLASTTFIWQPTEKGYYYLGTDFIRETTRIKQYSNDMKALRIGWRQNWGYVIATQVNGSIALKQYKDFASLGGILPLNKIRRDKIYSLNLTLWKQDWQYLGFTPKVQFRWKKQESNIPSMFSYSEKYVQMLVEKDF

SEQ ID NO: 211 - DNA, 1461 bp, H. parainfluenzae
ttgctttatttctctttcgataaaaaaatgaaatttacaaaaacttttttatatacagtattaagcataacatgtgctcagtgggcaaatgccgaggtagcacaatctaaaaatgacacattagacaaaaatattcaggttgcagcgccaaagcttcaagcacctgcgatccagccgaagacaaataatgaaggctcagtctcaatgactaaagaagagctagctcgtcatcctgatttaatcgtacgtgggatgattccttctgtattacaaaataacgaagaagcagtttcacttctgttgcctttatatcgagaacttccagaaaaagatcctgtgttattgagctgggctgaagctattgatgcgcgtcataaaggcaactatagtgaagctgcacaacgctatcgtacgctattcacccaacattctgatagccttccattacgttatcagcttgctcaagcactctttttaaataatgataacgaagcagcaaaagatcagttccaaaaattacgtgcggagcaaatgacgcctgaaatgactgccgttattgatcaatatttatctgcattaaatcaacgcgatcaatggaaattttatggtggtgtaagttacctcaatgaaagcaatatcaacaatgcacccaaagcaggtactcatattggtaactggaaagcttggagtaaagaaagtgcacaagggctttcttattcattaggtgttgagaaaaaatggtctcttgcacataactttttcaccaaattaggcttagatggaaatggtaaatactactggaataacaaaaaatataacgaattaaatgcgcgcttaggttggggattaggttatcaaacttcccatttagaattggctttaacaccatttaccgaaaaacgttggtatagtggtggctcaaacggtagcgatgcactcaaacaatactctaaaaactctggcgtacgttttgatattagctactggcttaatcctcgttggcaaatttcatctgctttggaatatggcgaacaacgctatgattggcgaaaacatttaaacggcaacaattatttattttccaacacattactctatgttccgaaaagcggacaacattggtttgctggggtagattattctcgtgaaaatactcgagacaaagataacgcctaccaacgagcaggtgtacgccttggttggggacaagaatggccatggggaatatcaagccgagtcacgctttcatatgctaaacgtcattatcaagcggctgatttctttaacatccgtcagaataatagagaatatgcttcaacgttaacattatggcatcgcgatctctatttctgggggattacgcctaaaattacatggtcctaccaaaaagtaaaaagtaatcatcctttctatggttacgataaaaatcgtgtattcttagaaatgagtaaaacattttaa

SEQ ID NO: 212 - protein, 486 aa, H. parainfluenzae
MLYFSFDKKMKFTKTFLYTVLSITCAQWANAEVAQSKNDTLDKNIQVAAPKLQAPAIQPKTNNEGSVSMTKEELARHPDLIVRGMIPSVLQNNEEAVSLLLPLYRELPEKDPVLLSWAEAIDARHKGNYSEAAQRYRTLFTQHSDSLPLRYQLAQALFLNNDNEAAKDQFQKLRAEQMTPEMTAVIDQYLSALNQRDQWKFYGGVSYLNESNINNAPKAGTHIGNWKAWSKESAQGLSYSLGVEKKWSLAHNFFTKLGLDGNGKYYWNNKKYNELNARLGWGLGYQTSHLELALTPFTEKRWYSGGSNGSDALKQYSKNSGVRFDISYWLNPRWQISSALEYGEQRYDWRKHLNGNNYLFSNTLLYVPKSGQHWFAGVDYSRENTRDKDNAYQRAGVRLGWGQEWPWGISSRVTLSYAKRHYQAADFFNIRQNNREYASTLTLWHRDLYFWGITPKITWSYQKVKSNHPFYGYDKNRVFLEMSKTF

SEQ ID NO: 213 - DNA, 1409 bp, H. parainfluenzae
agaatcaaaatgatcaagcaaaacttaatcaagccattaaaactgagcaacaaacattgcaaaaagcgcttttgaataaacaaagtttagaagagtcaaatgtcagtcgtaaggatgattacactcgttttacgggcaaatatttagtagaacacccagaaattttagaaaaaattcttgtagaatcacttattaatacgaataagcaagtacttcctacacttattgctttatataaacgtgtgcctaatagagatgaatccctacttgaatggggaaatgcaattctgttaactgataccaatttaaatgattctgtatcagaatatagaaagctcctggctaattttcctgataataattttattcgttttcagttagctcgagttttattttttaatcaggaatttgacgcgtcaaagaatcaatttgagaaattacgtgctgcagataatgtatcggctcaagatagagaagtgtttaaccaatttatctcagcaattaatgaaaaaagccaatggacttattctttcggtattacttatcttaatgataaaaatttaagtaactctgcaaaagaggggactatcgttgttttacctaatggtcaaacagcggtttataacacacctcgtcagaaagggaatggggtaggtatttctcttggtgccaataaacaatgggcattatcaggcggaaaatacattgtgttgaacacgggaatgaatactaaatattattggaataataaaaattataatgatttaacaggtgtgtttggtcttggtttaggatattctgatgctcgatttaatatagaagtacaaccttatgttaataaacgttggtattctggtggtgtgaatggctcagaaagtttaaaacaatattatgatacctatggtgtatcgctttccacttcctattggttaaatcaaagctttaagtattcattttactacgattatggatatgagaaatataaacaggaaaattatgctactcaatatcaaggcggtacgcatttaattagtaatagtttgatgtatgttccttcaccaacccaatattgggcattatctttagattttatgacgaaaaatgcaagagataaaagtaattccttcttaagagaaggtgcgcgcttaagctggggacaagaatggcctttaggtatttctactaatacatcctttggtattgcaaaaagaaattataaagaagcgtctttcttaggaaaacaaaagaataatgaatataatgcttccatctccatttggaataaaaaaattcattatgctgggttcacgccgcgcttaacgtggatttatactaaaacgaacagtaatatttctctatatacatatgataaaaatcaaatggttatagaagcgacgagaacattctaa

SEQ ID NO: 214 - protein, 492 aa, H. parainfluenzae
MKQPLLYGIVFSLLMPQCVDANEQNQNDQAKLNQAIKTEQQTLQKALLNKQSLEESNVSRKDDYTRFTGKYLVEHPEILEKILVESLINTNKQVLPTLIALYKRVPNRDESLLEWGNAILLTDTNLNDSVSEYRKLLANFPDNNFIRFQLARVLFFNQEFDASKNQFEKLRAADNVSAQDREVFNQFISAINEKSQWTYSFGITYLNDKNLSNSAKEGTIVVLPNGQTAVYNTPRQKGNGVGISLGANKQWALSGGKYIVLNTGMNTKYYWNNKNYNDLTGVFGLGLGYSDARFNIEVQPYVNKRWYSGGVNGSESLKQYYDTYGVSLSTSYWLNQSFKYSFYYDYGYEKYKQENYATQYQGGTHLISNSLMYVPSPTQYWALSLDFMTKNARDKSNSFLREGARLSWGQEWPLGISTNTSFGIAKRNYKEASFLGKQKNNEYNASISIWNKKIHYAGFTPRLTWIYTKTNSNISLYTYDKNQMVIEATRTF

SEQ ID NO: 215 - DNA, 1440 bp, H. paraphrohaemolyticus
atgaaattttcccccgctgttttatttgcaattttgggcatcaatctgaccgctttagcacaagctgaagtagcccagcctaaaaatgatctgaccgaacattttcaagttgctcagccgaaaataaagagtgctcctgttcctgaacaaactgagaaatctggcactgtgtcgatgaccaaagaagagttggctcagcaccccgatttaattgtgcgcgggttaattccagctgtgttgcaaaacaacgaacaagcggttgaattattactgccgatgtacaaaaacttgccgaatcaagatccattcttgcgtgactgggcagaggcgatttctgctaaatcacagggcaattttgcggatgctgtagcacgctatcgttctctttttgcacaaaaatcagatattcctgccttgcgttatcaactcgctcaagccctttttttaaataacaataatgaggcggctaaagatcaattccaaaaattgcgtgcagaaaatttatcgcccgattcagttgcaattatcgaccaatatttgaccgctttaaataaacgcgatcagtggaaatttagcggtggaatgagcttccttaatgaaactaacatcaataacgcaccgaaagcgggtacaaaagtaggcagttgggaagcctggaaaaaagagagtgcacaaggtttttcttactacttcaatactgagaaaaaatggtcgttaccaaatcaatttttcaccaaaatggaactgaatgcttcgggtaaatattattggaataacaaaaaatataatgaactcaatgtacgtgcaggtgcaggcttaggatatcaaactgcacgttttgaaattgccctcactccatttaccgaaaaacgttggtatgcgggtggttcatccggtagtgaatcgcttaaacaatattcaaaaaactcaggcgttcagcttgaaagcagttactggttgaatgaaaaatggcaactttcaagcgtgttggaatatggcgaacagcgttatgattggcgtaagcacttaaacggcaacaactatttgtggtcaaacacgctcttatatgtaccaaaaagcgggcaatattggtttgttggcgtagattacaaccgagaaaatacccgcgataaagacaacgcttaccaacgcaccactgctcgtttaggctgggggcaagagtggggctggggcatctcaagccgtgtttccctttcttatgcgaaacggacttatcaggctcatcctgcgcccgatttaatcggtaaaatacaaaaaaatgatgaatattcaactgctttaaccttttggcatcgtgatttacacttctttggtgtgacgccaaaagtgacttggcaatatcagaaagtaagcagtaaccacccgttttatagctatgacaaaaatcgggtttattttgagatgagtaaaacgttctag

SEQ ID NO: 216 - protein, 479 aa, H. paraphrohaemolyticus
MKFSPAVLFAILGINLTALAQAEVAQPKNDLTEHFQVAQPKIKSAPVPEQTEKSGTVSMTKEELAQHPDLIVRGLIPAVLQNNEQAVELLLPMYKNLPNQDPFLRDWAEAISAKSQGNFADAVARYRSLFAQKSDIPALRYQLAQALFLNNNNEAAKDQFQKLRAENLSPDSVAIIDQYLTALNKRDQWKFSGGMSFLNETNINNAPKAGTKVGSWEAWKKESAQGFSYYFNTEKKWSLPNQFFTKMELNASGKYYWNNKKYNELNVRAGAGLGYQTARFEIALTPFTEKRWYAGGSSGSESLKQYSKNSGVQLESSYWLNEKWQLSSVLEYGEQRYDWRKHLNGNNYLWSNTLLYVPKSGQYWFVGVDYNRENTRDKDNAYQRTTARLGWGQEWGWGISSRVSLSYAKRTYQAHPAPDLIGKIQKNDEYSTALTFWHRDLHFFGVTPKVTWQYQKVSSNHPFYSYDKNRVYFEMSKTF

SEQ ID NO: 217 - DNA, 1425 bp, H. paraphrohaemolyticus
atgaaaaaactcgcaaatttccttattattctaccgcttgcaacacaagcagaaacctttcacgcacctcaacctgtattctttgagaacaacgttttgccaaaacaggcagagccgcaaataaaaacgcagtctaaagcagagagtgtacccacatcttcatttgccctttctgatgcagatagcaccaaaaccaagctcgagaagttgattaacaatggtgtagtaaagcaacaatggcatttgttgaagcagctactgccgttgtatcaacagcaggcgaattatgatgaaacgctttatcgttacgcaatgggggcgatgttgcgggcagaaaaagaatacccacaggtaatttcgctttatcagcagattttagccgagaagccagagttagcttatccgcgttttgatttgggtgtgatgttgtttgaaaacaagcaatatcgccaggcgaaagcagagttagaacgtgctaagcccgaactttcaccacaaatgcagcagcttaccgaacgttatatgcaagcaatggcggagcggcaaagctggcagcctgatatggagctacaatatacccaaaccgataacataaacaacgcctcttctcagcaagatattatattgggaggattgagatttaaaaaagatgcggactccttgccgcaaaaggcacacggttttcgctacagtgtgggtgtaaaccgtgaattgaacatatccggcaatcattttgttacagcaaatggtcgttttggtggggtgcattattgggataaccaagattatagcgaaaaatcgctgtatgcctcgctcggttatcgataccgttctgcattgcaagcagtcggattttccccattttttgaacagaattggctcggctcaccatgttatagcaaaaattttggtgcagttgcagattttcgtcgagaattgactgcttactgggcaatgtcaggatctttttcgcatacgcaaaaacgctatgcacaagaaagcgtggctcgccgtcataatggttacttaaacggtgtttcactttcgttaagctatcaagccaagccgaattggttgctttttagtggtgtggaaggcagtgttgatcatagtaaagataaagcagaatcttctcttcgccgtggggtgaatattggttcggtgtgggagattaaagagtttgtcagccgtgttagcttacgttatgtgaagcgagattttcgtgcggagaatttttattttccaaccaaaaaacgtcaagataaagaatatagcttgaatgtgtcggtgtggcataaccgtttgcaatggcaaggttttgtgccgaagttgaattatcgctaccgtaaaattgatagcaatattcctgcgttctattccagagaaagtagcgagtggtttgtgtcagtagagaaagatttttag

SEQ ID NO: 218 - protein, 474 aa, H. paraphrohaemolyticus
MKKLANFLIILPLATQAETFHAPQPVFFENNVLPKQAEPQIKTQSKAESVPTSSFALSDADSTKTKLEKLINNGVVKQQWHLLKQLLPLYQQQANYDETLYRYAMGAMLRAEKEYPQVISLYQQILAEKPELAYPRFDLGVMLFENKQYRQAKAELERAKPELSPQMQQLTERYMQAMAERQSWQPDMELQYTQTDNINNASSQQDIILGGLRFKKDADSLPQKAHGFRYSVGVNRELNISGNHFVTANGRFGGVHYWDNQDYSEKSLYASLGYRYRSALQAVGFSPFFEQNWLGSPCYSKNFGAVADFRRELTAYWAMSGSFSHTQKRYAQESVARRHNGYLNGVSLSLSYQAKPNWLLFSGVEGSVDHSKDKAESSLRRGVNIGSVWEIKEFVSRVSLRYVKRDFRAENFYFPTKKRQDKEYSLNVSVWHNRLQWQGFVPKLNYRYRKIDSNIPAFYSRESSEWFVSVEKDF

SEQ ID NO: 219 - DNA, 1401 bp, H. parasuis
atgaaaaaacacctaccccttaccctttttattcccttagtagcaaacgcagcccctgaattggaaatcaaatccgccgagccaacattaccagtacaagcggttattttttcagaaaaatcagcaaataatggggaaatcactttaacccaagagctgctcagtaagcccgaacttactcgtcaaatgttaaatcgggcgattgatagccgacaatttcatttattgcctgagctggtgcggatttatcaacaaacgcctaatcctgatttggtgctgattgattatgctaacggtattattttggcaagtcagggggactataaaacggcaatcgatctctatcgtggcattattgcgaagcaccctaattttcagcccgtgcgttttcgtttagcacaaatgttgtttgaagatcggcaaaacgaagccgcacttgcacaatttcgtaagctacaagcggacggattgccgccacaaattgcaaatggggtggaacaatatattgctgccattcagaaacgttcggattggtcattcgactttggtgtgaattatttgcacgaaagcaatgttaataatgcctcaagctcgccttatgttcgagtggggaatgtgccgtttaagaaaacggaagaatcattaccgcaatcagcaaatgggttgagctaccatctgaatttggctaagaattggaatgttagcggatcccattatctacattttgagaaccaatttagtggaaaatcctattgggataatcatcaatttgacgatcagcaaaaccgttcaagtcttggctatcaatatcaaaatgctcaaagtcgtcttgcttttttgccttattatgaaatgcgttggtatggtaatcatcgctataatcacggctatggcgttcggggagaagtagagcattggcttacatcacaatggcagctttctacggctggcgaaatgggcaagctcaaacatcggggcgaaaatcagcttgcagatagcacaacattatttggttctgctacgctactctatgcctttgatgcgaaaagttatctctatggtggtgtagatttgttgcgagatcggacgttagaacgttctttagcctcaaaacgttatacagggcgaattggttgggggcaagaatggtggggcggaatttccagccgtattcagctcagttatggcaaacgtgaatttgaccaagctcaccgcatttttaatcagatacgcaaagatagagagttaggtttgaatgttacactttggcatcgtaacctgcatttttggggaattacaccgaaaatcagctatcaatatcagcgagtgaactcaaatttagtggatctttattcgtataaacgaaatcgagtttatttgagttttgagaaaagtttctag

SEQ ID NO: 220 - protein, 466 aa, H. parasuis
MKKHLPLTLFIPLVANAAPELEIKSAEPTLPVQAVIFSEKSANNGEITLTQELLSKPELTRQMLNRAIDSRQFHLLPELVRIYQQTPNPDLVLIDYANGIILASQGDYKTAIDLYRGIIAKHPNFQPVRFRLAQMLFEDRQNEAALAQFRKLQADGLPPQIANGVEQYIAAIQKRSDWSFDFGVNYLHESNVNNASSSPYVRVGNVPFKKTEESLPQSANGLSYHLNLAKNWNVSGSHYLHFENQFSGKSYWDNHQFDDQQNRSSLGYQYQNAQSRLAFLPYYEMRWYGNHRYNHGYGVRGEVEHWLTSQWQLSTAGEMGKLKHRGENQLADSTTLFGSATLLYAFDAKSYLYGGVDLLRDRTLERSLASKRYTGRIGWGQEWWGGISSRIQLSYGKREFDQAHRIFNQIRKDRELGLNVTLWHRNLHFWGITPKISYQYQRVNSNLVDLYSYKRNRVYLSFEKSF

SEQ ID NO: 221 - DNA, 1461 bp, H. parasuis
atgaatcactcgtttattagtgcaacacttttattagtcttagctaactactctatagcaaaactatctcaggatagtattactgaacatctaaatgataatagagtccaagcagaaaaagccgatatcctcattcacagccatcaatttaaggttcatcaaatcgctaaggaggaaacggataagagtagtattacaatgacttcaaaagagttggtaaaatatccagatttagtgataagagcattattgcctgcggtaatgcaaggtaatattgacaatgtcgaattgctttatcccatttaccaacagcttcctgcacaatttcacgatccaattctcaccaaatgggcatcggcaattgtggcaaagaaaaatcagcaatatacggaagcgatcaagttatatcgtcagatccttgccgaacaagcagatattcagcctgttcgtttacaacttgcggtagccctatttgaaaataacgaattagaggcttcagaagatcagtttaaaaaactgcgttctgaaccgcttatccccgaaattacccaacttatcgatcaatatcttaatgcgataaaccaacgagatcgttggacgttttcgggtggcgtgacttatcttaacgatcctaatatcaataatgcaccgaaagcaggaacaacctacggcaactggcacgcaccaaaacgaaaatcggcagaaggtgtcggttttaatttcgatctcggtaaaaaatggtcgtggggaaatggtttctttaatgaactacgtcttgctaccaacggcaaatactactgggataataaaaaatacaacgaaatgagcttacgaggcagtgtggggctaggttttcaaaatgcaaaatataacctgaggctgttgccatttatggaacaaacactttatgcaggtggctctaatcaaagtgataccttaaaacgtttttctaaatcaggcggtttaacccttgaaacaaactattggttatcacctaaatggcaactcaacactaactatgaatatgccgaacaacgctatgcaagtcgcttgcacctcaatggcaattatcactttatctctggtgggctagtttatttagccaatgcaaaccaatattggtttgcaaatttaaactacaatcgcaccgctactcgtgataaagatgatagctttttccgtcggggaattagtttaggttggggacaagaatggggcaaagggttttctactcgcctttccgtaagtgtagctcaaaaacgctataaaaaagaggcgattttccgcattattcaacgtaataaagaatatggcttcaatgcatcaatttggcatcgtgccgtgcatttatgggggatcactcctcgtttaacctacaattttactaaaacgcaaagtaaccacgttctttatagctatgataaacatagggtgtttattgagttgagcaaacaaatttaa

SEQ ID NO: 222 - protein, 486 aa, H. pittmaniae
MNHSFISATLLLVLANYSIAKLSQDSITEHLNDNRVQAEKADILIHSHQFKVHQIAKEETDKSSITMTSKELVKYPDLVIRALLPAVMQGNIDNVELLYPIYQQLPAQFHDPILTKWASAIVAKKNQQYTEAIKLYRQILAEQADIQPVRLQLAVALFENNELEASEDQFKKLRSEPLIPEITQLIDQYLNAINQRDRWTFSGGVTYLNDPNINNAPKAGTTYGNWHAPKRKSAEGVGFNFDLGKKWSWGNGFFNELRLATNGKYYWDNKKYNEMSLRGSVGLGFQNAKYNLRLLPFMEQTLYAGGSNQSDTLKRFSKSGGLTLETNYWLSPKWQLNTNYEYAEQRYASRLHLNGNYHFISGGLVYLANANQYWFANLNYNRTATRDKDDSFFRRGISLGWGQEWGKGFSTRLSVSVAQKRYKKEAIFRIIQRNKEYGFNASIWHRAVHLWGITPRLTYNFTKTQSNHVLYSYDKHRVFIELSKQI

SEQ ID NO: 223 - DNA, 1434 bp, H. pittmaniae
atgaagttgaatgcattaatgtgttgtttactagcaatactatccacacctctggttcaggctgaagttgcacagtcaaagaatgatagtttagatgagcgtttgtccattgctcggccgtctcagcctcaatccctttcacaagcagcgcaaaaaacatcaggccaaactctcaatctcagcaagcaggaactggcaaatcgcccagatcttattgtgcgggcattgattccggcggtgttagaaaataacgctaatgcggtgaaattgctcctgccgttgtatcaaaatgtgccgcagcaggatccatttttattgcaatgggcacaagctattgatgcccgtgagcaagggcaatatgagctggcgattcgtcattatcgtcgtctgtttgcccaagcaccggaaaatttggcaattcgttatcaattggcgcaagctttgtttttaaataatgataatgaagcggctcaggatcaattccaaaaattacgagctactcagcaagatcctgaaaacttgcgattgtttgatgcttatttgaatgcgctcaatcaacgtgatcgttggaagatttccggcgggctttcatttctcaatgaaagtaatataaataatgcaccgaaggcgggaacccgtattggtaactggcaggcatgggagcgggaaagcgcaaggggattatcttattctctcaatgttgagaaaaaatggtcactggctaatcatttgtttagcaaagtactgttggaaggcaatggtaaatattattgggataacaaaaagtataatgaatttacagcccgagttggtgtcggcttaggttatcaaaatgcccggacagaattttccgcgattccctttacggagcgtcgttggtatgctggcggctcaagaggcagtaagtcattaaaacgttattcccaaaatagtgggttacgcctagaactgaatcattggctcaatccgcaatggcaatatgccggcgcattggaatatggtgaacagcgttacgttactcgcaagcacctcaatggtaacaattatctctggtcaaatacgctgatttattatccccaaaatggtcagtattggtttgcgggtgtggattatagtcgggaaaatactcgtgatgcggataacgcctaccaacgtaaaaatgtgcgtttggggtgggggcaggaatggtcttggggaatttctactcgcgtgtccttaggctatgcgagacgaacctacaaaggtgccgatcttttccaaattcgtcagaaaaataacgagtacagcggcgctttcagtatttggcaccgcgatctctattttgggggaatcacccctcggttaacttgggcatatcaaaaaatcgatagtaatcatccgttttatagttatgacaaaaatcggatttacttagaaatgagcaaaaccttctaa

SEQ ID NO: 224 - protein, 477 aa, H. pittmaniae
MKLNALMCCLLAILSTPLVQAEVAQSKNDSLDERLSIARPSQPQSLSQAAQKTSGQTLNLSKQELANRPDLIVRALIPAVLENNANAVKLLLPLYQNVPQQDPFLLQWAQAIDAREQGQYELAIRHYRRLFAQAPENLAIRYQLAQALFLNNDNEAAQDQFQKLRATQQDPENLRLFDAYLNALNQRDRWKISGGLSFLNESNINNAPKAGTRIGNWQAWERESARGLSYSLNVEKKWSLANHLFSKVLLEGNGKYYWDNKKYNEFTARVGVGLGYQNARTEFSAIPFTERRWYAGGSRGSKSLKRYSQNSGLRLELNHWLNPQWQYAGALEYGEQRYVTRKHLNGNNYLWSNTLIYYPQNGQYWFAGVDYSRENTRDADNAYQRKNVRLGWGQEWSWGISTRVSLGYARRTYKGADLFQIRQKNNEYSGAFSIWHRDLYFGGITPRLTWAYQKIDSNHPFYSYDKNRIYLEMSKTF

SEQ ID NO: 225 - DNA, 1458 bp, H. somni
atgaaactcactttatcagccattcttcttctttttccggtttccgtactggcgcacagtcccaaaagtccgagcgaacatttggacgatcaccgcattgcagatgagcgggtacgtgaaaacattcaatatgccttggcgacacaacctaaacaaaccgttgtgccgaacattcagccacagcaaacggttgcattaagcgaaagccagttacagcaacatcctgatttacttgagcgtgcattgatagcggctttattgcaaggtaatggtgagaatgcctctttgctgttaccgcactatcaaaagttgcctgaaaacctgcaagacccgacttttcacctttgggcaaaagccttgattgcgcgttggcgtcatcaatatacacagtccgtgcgtttataccgccaagccttggcacaacaacctgattggtcggttttgcgtttacagaccgccgccgccctcttgtccaataaagaattcgatgcggcagaagctcagtttcgcaaggtgcaaagcgaaaatcagctacccgccggacttgcccaagaaattgaatcagttttgctgtatatcaaacggcaaagccgttggcaattcagtggcaacactacctatattaacgacaaaaatattaacaacgctcccaaaaatcctgatctgggcggaggttggcgaggtgatcaggctgagtccggtcaagggttagccgttaatttgggcaccaataaaaaatggttttggaaaaatggattatttaatgaatggcgtttagacagcaacagtaaattttattggaacaacaaacgattcaacgaagccaatgtgcgtgcttcaatgggtatcggttatcaaaatgctaaaaatagcattaccgttctgccattttttgagcaagcgtggtatgcagggggcaagaaaggcaatgagaccttacgacgtttttccaacagtcgaggtattgcactagaagcaacccacacttttagccccaaatggcaggggagtctgacagctgagacggcacaaaatcgttatcggacacgtaagcatttaaacggtaatacgcactttgtttctttatcggcggtgtatcaacacaatccgagtcaagcttggtttggaggaatagactggcatcgcaacaacgcacgagatggcgatgattcttttgaccgtatcggggtacgggcaggctggttgcaagactggaaaggactttccacacgcttaattacttcttatggcaaaaaaaactatcgcagtgcaggctttttcaacaaaacccaacgtaatcgagagttgggcgtacaggtcagtgtatggcatcgagccgtacactggcaaggtttaacaccacggttaacatggtcatacactaaaacggatagtaacataccattgttccgttacaacaaacagcgcctgtttctggaaattaataagcagttttga

SEQ ID NO: 226 - protein, 485 aa, H. somni
MKLTLSAILLLFPVSVLAHSPKSPSEHLDDHRIADERVRENIQYALATQPKQTVVPNIQPQQTVALSESQLQQHPDLLERALIAALLQGNGENASLLLPHYQKLPENLQDPTFHLWAKALIARWRHQYTQSVRLYRQALAQQPDWSVLRLQTAAALLSNKEFDAAEAQFRKVQSENQLPAGLAQEIESVLLYIKRQSRWQFSGNTTYINDKNINNAPKNPDLGGGWRGDQAESGQGLAVNLGTNKKWFWKNGLFNEWRLDSNSKFYWNNKRFNEANVRASMGIGYQNAKNSITVLPFFEQAWYAGGKKGNETLRRFSNSRGIALEATHTFSPKWQGSLTAETAQNRYRTRKHLNGNTHFVSLSAVYQHNPSQAWFGGIDWHRNNARDGDDSFDRIGVRAGWLQDWKGLSTRLITSYGKKNYRSAGFFNKTQRNRELGVQVSVWHRAVHWQGLTPRLTWSYTKTDSNIPLFRYNKQRLFLEINKQF

SEQ ID NO: 227 - DNA, 1254 bp, H. somni
atgaaaaaattgatatttattttatttgttagttgttatattcctgttgtaacagcaaatttccaacaagaaagaaattacagtataagattatcgagaaatgatacaaagttaacagaaagcctgttagtaagtatgttgaaatcacagcaatttcatgcagcggagaaaatgctagctatttatcaaaatattgataatccgagccctcaattaatcaattacacaaagatttatcttgctcagcaatactacagaaataaacaatataaaagagcactttctctttttttagaattaaagaaacaagctaatttaacagataaagagaaagttattattgagcagtatctttctattcttgaggagcaagaaagttggcaattttcattctctgcaaattatcttcgcaataaaaacgtaaataatgcatcttctgaacgacaaatagaagatactggatttagtaagaatgatgatatgttgccacaatctgcaacagggttggcttattatttttctgctgaacgaaattggaatttagtagattctcattatttgcacttctccaatgagctttttggtaagtattattgggataataaagatttcgatgaaagtaataaccgcacttatattggttatatttatcaaaatgcaaaattaaaatttgcctctaaagccttttacgaacgtcaatggtttgcaagacaccgttataattgggcaaatggattgaggactgaattagagtattcattagcaccaaaatggaaaatatcgacggcgatagaacttagccagcctcattatttcaaacaaagagaaaagaatggcacaagtaaacttatttcattcaccttaatttggcaaccaaatcatcttagttatttatattggggaatagattttattcgtgaaaaaacacaactaaaacaatatagcaatgatactaaagggttaagattaggttggagtagaatttggacgggaaattttatcactcaaatcaattcctctatttcttggcgaaattataaagataaagcgtctttaggcggaatccttcctcttgataaaattcgtaaagataaaatttataatgctaatttaacagtttggaaatctgattggaactggtctggatttactcctaagctccaattcaaatataagaagcaaaaaagtaatatcgcttctgttttttcttatactgaaaagaatgtacagttggttatcgaaaaaactttttag

SEQ ID NO: 228 - protein, 417 aa, H. somni
MKKLIFILFVSCYIPVVTANFQQERNYSIRLSRNDTKLTESLLVSMLKSQQFHAAEKMLAIYQNIDNPSPQLINYTKIYLAQQYYRNKQYKRALSLFLELKKQANLTDKEKVIIEQYLSILEEQESWQFSFSANYLRNKNVNNASSERQIEDTGFSKNDDMLPQSATGLAYYFSAERNWNLVDSHYLHFSNELFGKYYWDNKDFDESNNRTYIGYIYQNAKLKFASKAFYERQWFARHRYNWANGLRTELEYSLAPKWKISTAIELSQPHYFKQREKNGTSKLISFTLIWQPNHLSYLYWGIDFIREKTQLKQYSNDTKGLRLGWSRIWTGNFITQINSSISWRNYKDKASLGGILPLDKIRKDKIYNANLTVWKSDWNWSGFTPKLQFKYKKQKSNIASVFSYTEKNVQLVIEKTF

SEQ ID NO: 229 - DNA, 1434 bp, H. sputorum
atgaaattcacaaaaacttttttatattctgtactcggtatgacgtgcgcaaacttagccaatgctgaagtcgcacaatctaaaaatgacaatctagatgataacattcaggttgccacacccaaatttcaagcgcccactgttcagcctaaagtgaataatcaaggctcagtttctatgactaaagctgagttggcacaacatccagatttaattatacggggaatgattcctgcggtattacaaaataatgaagaagttgtctcattactattacccttatatcgagaaatccctcaaaaagatcccgtcttgctgagttgggcagaagcgattgatacgcgccatcaagggaattatagtgaagctgcgcagcgttatcgtaccttgtttactcagcattctgatatcttaccgctacgttatcagcttgctcaggcactttttttgaataatgataatgaagcggcaaaagatcaatttcaaaaattacgtgcagaagagatggcgccagaaatgacagccgtcattgaccaatatttatcggcattaaatcagcgtgaccagtggaaatttagtggcggtgtcagttttctgaatgaaacgaatatcaataatgcacctaaagctggtacgcatattggtagctggcaagcctggaaaaaagaaagtgcacaagggctttcctattcattaggtttggataaaaaatggtctttaccaaataacttttttactcaacttggacttgatggtcaaggtaagtattactgggataataaaaaatataatgagttaaatgtacgcctaggctggggattaggctatcaaacctctcgtttggaattatctttaacgccatttactgaaaaacgttggtatagtggcggctctagcggaagtgatgcactaaaacagtattcaaaaaattctggtgcccgttttgatatcagttactggcttaaccctcgttggcaaatttcctctgcattagaatatggcgagcaacgttatgattggcgtaagcatttaaacggcaataattacttgttctctaacacattactctatgttccgaaaagtggccaatattggtttgcagggttagattattctcgtgaaaacacgcgagataaagataatgcttatcaacgaatgggtagtcgacttggttggggacaagaatggccgtggggcatatctagccgaattacgctttcttatgctaaacgtcattatcaagcggtagatttctttaatattcgccagaaaaaccgagaatatgcttcaacattaaccctgtggcatcgcgatctctatttctggggcattacacctaaaatcacttggtcttatcaaaaggtgaaaagtaatcatcctttctatggctatgataaaaaccgtgtattcttagaaatgagcaaaacattctag

SEQ ID NO: 230 - protein, 477 aa, H. sputorum
MKFTKTFLYSVLGMTCANLANAEVAQSKNDNLDDNIQVATPKFQAPTVQPKVNNQGSVSMTKAELAQHPDLIIRGMIPAVLQNNEEVVSLLLPLYREIPQKDPVLLSWAEAIDTRHQGNYSEAAQRYRTLFTQHSDILPLRYQLAQALFLNNDNEAAKDQFQKLRAEEMAPEMTAVIDQYLSALNQRDQWKFSGGVSFLNETNINNAPKAGTHIGSWQAWKKESAQGLSYSLGLDKKWSLPNNFFTQLGLDGQGKYYWDNKKYNELNVRLGWGLGYQTSRLELSLTPFTEKRWYSGGSSGSDALKQYSKNSGARFDISYWLNPRWQISSALEYGEQRYDWRKHLNGNNYLFSNTLLYVPKSGQYWFAGLDYSRENTRDKDNAYQRMGSRLGWGQEWPWGISSRITLSYAKRHYQAVDFFNIRQKNREYASTLTLWHRDLYFWGITPKITWSYQKVKSNHPFYGYDKNRVFLEMSKTF

SEQ ID NO: 231 - DNA, 1308 bp, H. sputorum
atgcgtaagcttttttattctcttttcttttgttcaacttttgtctgggcttcatctaatggttcaattaccgcattagaagaacaacttaaacaagcgatttatcaaaataatgcagagcaaattcaatcctttctttctcaatatcaacaacaaacgcaacaggatcccttgctgctttcttatgcggaagcgaaactagcgagtttgcgccaagattatgcccttgcaattcgtatttaccgaaaaatgttgagcgaacgtccagcgctcacttctatccgaatggaacttgccaaagtgttatttgcagaccgtcaagacatcgcggcgagattgcaatttgataaggtaaaaagcgttaaaaatttgcctgcttcggcttatcagcagattgatcgttatattgacgcacttaattcgtataatacttggctgattgatgcgagtgtttcctatcttaaaacggataacgtggaaaatgtctcctctgcgacaagcattgaaaatacaggttttattaagggtgaacgtatgttgccacaaaaggctcatggtttttcctacaacctgagttttagccgtgattttaatattgtgggttctcactatgtaggttttagtaatgaaactaacggaaaaagctattgggacaatcatcaattcgatgatctttttaaccgtacttctgtggggtatgcctacaagaaaaatgaggcaacattcaggctacagccgttttatgaaaaacgttggtatggcggcgaagcattccattggtcaaatgggatcgaaatgagttatagctattggctttctaaaaattggcaaaatcagaccgcacttgaatatgaaaaacgccgtttttttatcgagaatccccaagctggtaatattaaaaccgcctcaaataccttgatttggtatcgaaaccctgaacaaatcttttatacagggatagctttttctcaacaaaaactccttgagcgtcaatatagttcagatataaaaaatgtgcggattggctggttacaagaatatgcttgggggatttccacaaaactcaatctatcatttacccatcgccaatttaaagatcaagcggttctcggcggtattttacctttgggcaagacgaggaaagatcatatttacaccatttttgcacaagtgtggaaacgtgattggcatttatggggcattacgcctaaactcaattttgaatggcgaaaacaaaaaagtaatttagatacaatgtattcctataaaatgcacaacctgactttgagttttgagaaaactttttaa

SEQ ID NO: 232 - protein, 435 aa, H. sputorum
MRKLFYSLFFCSTFVWASSNGSITALEEQLKQAIYQNNAEQIQSFLSQYQQQTQQDPLLLSYAEAKLASLRQDYALAIRIYRKMLSERPALTSIRMELAKVLFADRQDIAARLQFDKVKSVKNLPASAYQQIDRYIDALNSYNTWLIDASVSYLKTDNVENVSSATSIENTGFIKGERMLPQKAHGFSYNLSFSRDFNIVGSHYVGFSNETNGKSYWDNHQFDDLFNRTSVGYAYKKNEATFRLQPFYEKRWYGGEAFHWSNGIEMSYSYWLSKNWQNQTALEYEKRRFFIENPQAGNIKTASNTLIWYRNPEQIFYTGIAFSQQKLLERQYSSDIKNVRIGWLQEYAWGISTKLNLSFTHRQFKDQAVLGGILPLGKTRKDHIYTIFAQVWKRDWHLWGITPKLNFEWRKQKSNLDTMYSYKMHNLTLSFEKTF

SEQ ID NO: 233 - DNA, 1491 bp, Haemophilus sp. C1
atgaaaaaaacattcctatttctcaccgttctttttcccatttttgcctcggcagaaatcttagtgcaagatgttcgtcaaatcccagtaaatactgactttgataataaaattaatattgcgaaacctgaaaaacgagaaccaaatttaccgcacttaggtacagaacaagccgaacaaattcaaattacccttgagcaacttaaacaaaacccagttttaacccacgaattattaactcgtgccatttatgcccgcaatccagaaatgattaaaaaattgctggaaatttaccgcacttttccaaatcgtgacccgattatggaacgctttgcggaagggaaattggctgcgataacggaaaactatactgtagccattgataaatatcgtgaaattttagccaaaaatccaaatttaaatcctgtgcgaattgaactggctatcgctttattcaatcaaaaacaagatggtgctgccaaagaccaatttgaaaaagcgcaaactgcagggaatttaccgcctcaagttaagcgtttaatggatgcttatttagaggctttaaaagaacgtgatagctggaatgtggatttttcttttaactatgtgcgagataccaatgtgaataatgtcggcagtggacgccgtttagttctacgtaatggtggggtaattactcgccctgaatcaatgttgcctcaaactgcacacggattggcgtattcactggatatttcgagagatttcaatttatggcgttctcattacctcacagtgggtaatgcgttcgggggcaagagttattgggataatcatgaatttgatgatatttccaaccgcacttttgttggctatgcgcataaaaccacgaagcaaaatttccgtattaaacctttttatgaaaaacgttggtatggtggcgaaagttaccgttggtctaacggggcaagggtagaattttctcgttggttaagcccgaattggcagatttctacggcgggagaattttccaaacaacgttatctcgacagtacatcacaaaacggcaataacaaactaatttcagcaaccttactttgggcaagaacaccaaaacagtttttctatctcggttctgattttatggcagaaagaacgaaggttcgtcaatatagttcagacactaaaagtttacgtttaggttggggacaagagtggggatggcttggtttttcttctcgtttaaatttatcttttacgcaaaggcaatacaaagatgtattaactttgggttcataccaaaccccgttaggcttgcttgatctttccgtaggtaaaaaacgaaaagataaaatttacggtgtgaatttatccctatggaaacgtgactggcatatttgggggattacgccaaaactccaattaagctggcgtaaacaagatagtaatattccagaaatgtattcttacactcagaagaatgtgaatgtgttatttgagaaaaccttttaa

SEQ ID NO: 234 - protein, 496 aa, Haemophilus sp. C1
MKKTFLFLTVLFPIFASAEILVQDVRQIPVNTDFDNKINIAKPEKREPNLPHLGTEQAEQIQITLEQLKQNPVLTHELLTRAIYARNPEMIKKLLEIYRTFPNRDPIMERFAEGKLAAITENYTVAIDKYREILAKNPNLNPVRIELAIALFNQKQDGAAKDQFEKAQTAGNLPPQVKRLMDAYLEALKERDSWNVDFSFNYVRDTNVNNVGSGRRLVLRNGGVITRPESMLPQTAHGLAYSLDISRDFNLWRSHYLTVGNAFGGKSYWDNHEFDDISNRTFVGYAHKTTKQNFRIKPFYEKRWYGGESYRWSNGARVEFSRWLSPNWQISTAGEFSKQRYLDSTSQNGNNKLISATLLWARTPKQFFYLGSDFMAERTKVRQYSSDTKSLRLGWGQEWGWLGFSSRLNLSFTQRQYKDVLTLGSYQTPLGLLDLSVGKKRKDKIYGVNLSLWKRDWHIWGITPKLQLSWRKQDSNIPEMYSYTQKNVNVLFEKTF

SEQ ID NO: 235 - DNA, 1506 bp, Haemophilus sp. FF7
atggtttctttctatattaatcaccgccatataacgggcataatttttcattttctcccaccgttattaatagccgcttgtacaacggctttggcagcggtacaaacgccaaataatcatgatgccgttcaactttggcagcaacacagccagataagccgacaacagcaacaggaaagtcaggtggatgaacaagcaattgatgcgcagacaaccgaaaatgaactctctttcgacggtcaatcagtggttattgaacataacgccgaagcggtcgggcaggtactattcttcgccttaaaccgacagttatgggatgaggcggaaaaacttctgattcgttatcgaactttcaaggatcatcatctcgaattggttttatttgctgaagccgcactggcgcgccaaaaaggcgacatggatacggcggaacagcgctatcgtcaactactgcaggcagatccgagctttatccgcgctcagttggatctggcacgcgtgctgtttgaaaataaaaaaagccgagaatccaccgcactttttaatcaactggcgacattaccactgccgaatagcgtccggtacagtatcgacagctaccgtcaggcattggcacagcgacaaaaatggcagctgtctttcagcttagggtatcagtacgctaccaatatcaatcaatcttccgaacgcagtttctgcacgctgaaccaaggcactcactgcttcgctcgctttacctcgccgcctgccgccaatgcgcagggctggcgttatgatgtcagtgcacagaaacagacggcattatccggtcatcacggcatgtacttttatctgaacagctacggccatttttatccgcatgccggagaatatgccgaagacagcagcaaagtttaccttggctatcgttatcagaacatgaaaaccgaactgaccctgacgcccttgtttgaatataatcgcctaggcaaccgcacttattcgcgggcgtggggcgtacaaagcacactgaaccgccgaatcggtacgcagcattggctgaatatacaaatggaacaaaaaaggctgcaatattcaccgcactataacgcactacgcatggcggatctgagtgcgctttatacgactttgtattacaccgtttccgaccaaacaaccttgtttggcgggcttgacgggcaatatcgacataccacgaatgacgctgacaattattatctgtatgggctacgcgcaggcataaaccgacaatttgagttcgggctggatgcgactctgctggcgttattgcgccgttatgactaccagggcttcaatgcatcgttaaaccagacccgacgggataatcaacaggtttatctggccatattaaaaatgccgacatggcagttttacggcatgacgccgagtctatggctgaaacacaccgataatcggagtaatgttgactggctgtattcctataaacagaatgaaattcaactgaatttcgagtggcaattttaa

SEQ ID NO: 236 - protein, 488 aa, Haemophilus sp. FF7
MIFHFLPPLLIAACTTALAAVQTPNNHDAVQLWQQHSQISRQQQQESQVDEQAIDAQTTENELSFDGQSVVIEHNAEAVGQVLFFALNRQLWDEAEKLLIRYRTFKDHHLELVLFAEAALARQKGDMDTAEQRYRQLLQADPSFIRAQLDLARVLFENKKSRESTALFNQLATLPLPNSVRYSIDSYRQALAQRQKWQLSFSLGYQYATNINQSSERSFCTLNQGTHCFARFTSPPAANAQGWRYDVSAQKQTALSGHHGMYFYLNSYGHFYPHAGEYAEDSSKVYLGYRYQNMKTELTLTPLFEYNRLGNRTYSRAWGVQSTLNRRIGTQHWLNIQMEQKRLQYSPHYNALRMADLSALYTTLYYTVSDQTTLFGGLDGQYRHTTNDADNYYLYGLRAGINRQFEFGLDATLLALLRRYDYQGFNASLNQTRRDNQQVYLAILKMPTWQFYGMTPSLWLKHTDNRSNVDWLYSYKQNEIQLNFEWQF

SEQ ID NO: 237 - DNA, 1470 bp, Haemophilus sp. oral taxon 851
atgaaaagtattgctttcttttttactgcacttttccccgctcttgctttagcagaaacaacggcactagatattcgtcaaacaccaattaaaaccgaacttgaaccacaaattaatgtcgccaaacttgaaaaacgcgaacaaaatttaccgcccttaggcacagagcaagtcgaacaaattcaaattacccttgagcaacttaaacaaaaccccgctttaacccacaaattattaacccgtgccatttacgcacgcaatccagaaatgataaaaaaattgctggaaatttaccgcacttttccaaatcgtgacccgattatggaacgctttgcggaaggaaaattggctgcgataacggaaaactatactgtagctattgataaatatcgcgaaattttagccaaaaatccaaatttaaaccctgtacgaattgaactggctatcgctttattcaatcaaaaacaagacggtgctgctaaagaccaatttgaaaaagcacaaaccgcagaggatttaccgcctcaagttaagcgtttaatggatgcttatttagaggctttaaaagaacgtgatagctggaatgtggacttttcttttaattatgtacgtgataccaatgtcaacaatgtcggcgagggtaaaacggtcgcattaaataatggtggcaccttaacacgttccgaatcgatgatgccacaaacagcacacggtttggcgtattcactcgatatttcgagagatttcaatttatggagctctaattacctcacggtgggcaatgagtttgggggaaagagctactgggataatcataaatttgatgatatttccaaccgcacttttgttggctatgcacataaaaccgcaaagcaaaatttccgtattaaacctttttatgaaaaacgttggtatggcggcgaaagttaccgttggtctaatggggcaagggtggaattttctcgttggttaagtccaaactggcaactttttacggcgggagagttttcaaaacaacgttatttagacagtacatcacaaaacggtaataacaaactgatttccgcaaccttactgtgggcaagaactccgaaacagtttttctacttcggttctgatttcatggcagaaagaacgaaggttcgtcaatatggttcagacagtaaaagcttacgtttaggttgggggcaagaatggaattggggcatttcctcacgtctcggcttatccataatgaaacgtgaatttaaagatattgccaaacttggtaatctcaatttgttttcttttggaaaacgtcgagaagataaaatttacggcataaatttatccctatggaaacgcgattggcatatttggggaattacaccaaaactccaattaagctggcgtaaacaagatagcaatatcccagaaatgtattcttacacacagaagaatgtgaatatgttgtttgaaaagacattctga

SEQ ID NO: 238 - protein, 489 aa, Haemophilus sp. oral taxon 851
MKSIAFFFTALFPALALAETTALDIRQTPIKTELEPQINVAKLEKREQNLPPLGTEQVEQIQITLEQLKQNPALTHKLLTRAIYARNPEMIKKLLEIYRTFPNRDPIMERFAEGKLAAITENYTVAIDKYREILAKNPNLNPVRIELAIALFNQKQDGAAKDQFEKAQTAEDLPPQVKRLMDAYLEALKERDSWNVDFSFNYVRDTNVNNVGEGKTVALNNGGTLTRSESMMPQTAHGLAYSLDISRDFNLWSSNYLTVGNEFGGKSYWDNHKFDDISNRTFVGYAHKTAKQNFRIKPFYEKRWYGGESYRWSNGARVEFSRWLSPNWQLFTAGEFSKQRYLDSTSQNGNNKLISATLLWARTPKQFFYFGSDFMAERTKVRQYGSDSKSLRLGWGQEWNWGISSRLGLSIMKREFKDIAKLGNLNLFSFGKRREDKIYGINLSLWKRDWHIWGITPKLQLSWRKQDSNIPEMYSYTQKNVNMLFEKTF

SEQ ID NO: 239 - DNA, 1422 bp, K. denitrificans
atggatttcttttggacgcggttgcggcatatcgtttggctggcgttgcccctgcaggctgcttttgccgcgccgcccgaacctcgccccgaaccggatacgggcttcgacattacgccgcaggccgccccgaaggtggaaagcccggccgtgccgcaggacgggcgattgaaaatccgccgcgaagagctgctgcaacgccccgagcttctgcagcaggcattgagttatgccgtgctcgccaacgacaaagacggcgtggaacttttgctgccgctgtatttgcaacagcaggcaccgcgcgacgaattgctggtcacgttggcacaggccgttttggcgcgcgcagaaggcgattaccgccgtgccgttgccttatatcgcgccgcgttggaaaccgaccccgatttgcccaccgttcggttggcattggcgcaatcactgtttgaaaaccgcgccgacaaagccgcacggcaagaattggaacgcttccgccaaacgcccgatttggcacccgaatacgcccaaatcggcgaacaatatgcacaggcattggacaagcgcgaccgctggacgtttggcggcaccgtcagctatctccgcgacggcaacgtgaacaacgccccgcaccaacgcgaataccgcacccgcaggggcgtatggcggctgccgaaagccgagtccgcacaaggatttgcctaccgcttggaagtcgaacgcgattggaatctccacggcaatgcctattggcgcgtccatttgggcggcgaaggcaaatggtattgggacaaccaccgctatgacgaccacaacgcccgcatcgccaccggctttgcctataaaaccgcccgcaccgaagccgccatcaccccgtattttgaacgccgctggtacggcacacacccttattcgcgcgaatacggcgtgcgtgccgaagggcaatattggctcaccccgcgaaacaaaatcctgggcgcatttgaatttggccggcaacgccacgaccgccgccgctggctggacggccgccaatataccgcctccgccacttggttgttcgcacgccgccccgaccaatatttcagcttcggcgcagatggcgcaagcaaacaggcggaagacgccgccgaatcctacacccgccaaggcctgcgcttcggctggacgcaacaatggccgtccgggctcgccacatccgcccatatcggcatcggccgccgccgctaccacgccgcagactggttcggcatcctgcgccgcgaccgcgaattttccgccagcatgtccgtgtcacaccgcaaaatccaatttgccggcattaccccgcaaatcgtcggcgtgtggcaatgtgtccgcagcaaccattttttctatcctttccgcaaaggcaacgtgtttatccagttcggccggacattttga

SEQ ID NO: 240 - protein, 473 aa, K. denitrificans
MDFFWTRLRHIVWLALPLQAAFAAPPEPRPEPDTGFDITPQAAPKVESPAVPQDGRLKIRREELLQRPELLQQALSYAVLANDKDGVELLLPLYLQQQAPRDELLVTLAQAVLARAEGDYRRAVALYRAALETDPDLPTVRLALAQSLFENRADKAARQELERFRQTPDLAPEYAQIGEQYAQALDKRDRWTFGGTVSYLRDGNVNNAPHQREYRTRRGVWRLPKAESAQGFAYRLEVERDWNLHGNAYWRVHLGGEGKWYWDNHRYDDHNARIATGFAYKTARTEAAITPYFERRWYGTHPYSREYGVRAEGQYWLTPRNKILGAFEFGRQRHDRRRWLDGRQYTASATWLFARRPDQYFSFGADGASKQAEDAAESYTRQGLRFGWTQQWPSGLATSAHIGIGRRRYHAADWFGILRRDREFSASMSVSHRKIQFAGITPQIVGVWQCVRSNHFFYPFRKGNVFIQFGRTF

SEQ ID NO: 241 - DNA, 1410 bp, K. denitrificans
atgcgttacattccttttcttctgctcgccgccgcatccgccgtgtctgccgcgcctgtcggcacaccgctcaaccccattcccgatttaaaccaaaacagcattcgggaacacgtgcaggacaccgaaaagcagcctgcacccgaaccacaagcccccgtccaaatgagcgaagagcagcttttgcagcagcctgcactactgctcaatgccttggacaccgccgtgggccagcaaaacaccgacaatatccgcttcctgctgccgctttaccgcaggctgcctgccgaacagcaagaccccgtgttggcagaatatgccgaagccatcctcctacgcgcagacggccgccatgacgccgccgaacaaaaactgcgccaaattctggaaagaaaccccgaattttcccccgtgcgcctgcaactggcgctaacccaatcgcaaaacggcaaacagcgcgaagccgccgccgaaatcgcccgaatccggcaaacgcccgaactgcccgcccccgtcgcccaatacctcgaccaatacgaacaatacctgaaccgagaacgcgcctggcaattcagcggcaacgcctattacctgcaagacaacaacgtggcgcgcgcccccgaacagcgcacctacggcgcatggcagtttaacgaaccccaatccgcgcacggcatcggctacgaattttcggcacagaaaaccacgcccgtcaaaggccactgggcggcacgcgtgcaggctgccctctacggcaaattttactgggatgcacatgattacgacgacttggtcgcccgcgccgaagccggccccgtgtggcgcgacgcacggcaggaaatctatgccgccccgttttacgaacaacgctggtacggcaccgaacccttttcccgccaattcggcggcagcatccactattcgcgcaccctgtcgccgaattggcaaatgtatgccgcctggcagtccggctacaaacaacacaacgagcgcaccttcctcaacggcaccagccacaccggttcgctcaccctgctctaccgcacatcgccgcagcaatatttcgtgatgggcatcggcggcgggcaggaaaacgccaaagacctgtcggacgcataccgcaaaagcagcctgcacggcggctggacgcgccactggggcagcagccgcgccttcgccacatcgctcaacatcagcgtgcagcgcagaaactaccgcggccccgacatcttcaatatccagcgccgcgacaccgaatacttcacccgcctggcgctgtcgcacagccgcctctcctggaaaggcttcaccccgcgcctgaactggacctggtcgcacatccacagcaaccatttctattaccgctataacaaccaccgcgtgtttttggatgtattcaagcagttctga

SEQ ID NO: 242 - protein, 469 aa, K. denitrificans
MRYIPFLLLAAASAVSAAPVGTPLNPIPDLNQNSIREHVQDTEKQPAPEPQAPVQMSEEQLLQQPALLLNALDTAVGQQNTDNIRFLLPLYRRLPAEQQDPVLAEYAEAILLRADGRHDAAEQKLRQILERNPEFSPVRLQLALTQSQNGKQREAAAEIARIRQTPELPAPVAQYLDQYEQYLNRERAWQFSGNAYYLQDNNVARAPEQRTYGAWQFNEPQSAHGIGYEFSAQKTTPVKGHWAARVQAALYGKFYWDAHDYDDLVARAEAGPVWRDARQEIYAAPFYEQRWYGTEPFSRQFGGSIHYSRTLSPNWQMYAAWQSGYKQHNERTFLNGTSHTGSLTLLYRTSPQQYFVMGIGGGQENAKDLSDAYRKSSLHGGWTRHWGSSRAFATSLNISVQRRNYRGPDIFNIQRRDTEYFTRLALSHSRLSWKGFTPRLNWTWSHIHSNHFYYRYNNHRVFLDVFKQF

SEQ ID NO: 243 - DNA, 1428 bp, K. denitrificans
atgaacatccgccctattttctggctgctgcccgccctattcgccgcacaagtgcaggctgccccgttgccgcccaaagtggaacagtcgctcaccgcaccggaagaacacttcgacaaacagccgcccgcagacgtgcccgcaccaccccaaccgccgcaacaaagcgaatccggcagtctgaccatttcatcggaagaactgcaaaagcagcctgcacttttgaaacaggcgttttattcggccatcgccgccaacaacacgcccgccgtgcgcctgctgctgcccttgtaccgccgcctgcccgacggcaacgaagaagtgccgattgcactgtccgaagccataattgcgcgcgcagacggccattacgcccaagccatcgaaaaattccgctttgccttggacaagcagcccgatatgcccgtggcgcaaatgtcgctggcgcaaaccctgcacagcgactaccgctacccgtccgccgccaaagcatttgaagaaatcgcgcagcgcaccgatttgccgcccgaattccaccaagtcgcccaaacctacctgaacagcatcaaagcgcgggaagactggaaattccaagtgaacggcaattacctggacgacaaaaacgtgggcaacacgcccgaccgctacatcatcggcgcatggtcgctcaatccgcccgaatccgcacacggcatctcgtattacggcagcgtgtcgcgcgaaaaatggctggccgaccacttcaccctgcgttacggcgccgacctatacggcaaaacctattgggacaaccaccgtttcgacgatttggccgtgcgcgtgaaagccggattcggttatcagacaggccgttccgaaaccgtggtgcagccctatttcgagcgccgctggttcggcagcgacggctattcgcgcgagttgggcattggcatcgactggtcgtattggctaaccgcgcgcaaccagctgatgctttccgccgcgcacgccacacagaattatgacgaccgccgctatttggaaggccgcctgcgcaccgcgtccgccacatggttgtttgtgcccagcggcacgcagtattggacgctcggcacggactggacgcgcaaaaccgcacaagacgccagcgatgcctaccgccgccaagccgttcgtgtcggctggacgcagcaatggccggcacagttcggcacgtcggtgaatctgtcgtgggcgaaacgcacctacgaccgcccgaattttccgttcaactacatccgcatcgaccacgaacgttccgccgctgtgtcgctttggaaccgcaaagtccaatggtggggcatcatgccgcgcctggtgtggcgttggcagcaaacgcgcagcaaccacccgttttacggcgattacaccaaacgcgatgtgtttatccagttgaacaaggcgttttaa

SEQ ID NO: 244 - protein, 475 aa, K. denitrificans
MNIRPIFWLLPALFAAQVQAAPLPPKVEQSLTAPEEHFDKQPPADVPAPPQPPQQSESGSLTISSEELQKQPALLKQAFYSAIAANNTPAVRLLLPLYRRLPDGNEEVPIALSEAIIARADGHYAQAIEKFRFALDKQPDMPVAQMSLAQTLHSDYRYPSAAKAFEEIAQRTDLPPEFHQVAQTYLNSIKAREDWKFQVNGNYLDDKNVGNTPDRYIIGAWSLNPPESAHGISYYGSVSREKWLADHFTLRYGADLYGKTYWDNHRFDDLAVRVKAGFGYQTGRSETVVQPYFERRWFGSDGYSRELGIGIDWSYWLTARNQLMLSAAHATQNYDDRRYLEGRLRTASATWLFVPSGTQYWTLGTDWTRKTAQDASDAYRRQAVRVGWTQQWPAQFGTSVNLSWAKRTYDRPNFPFNYIRIDHERSAAVSLWNRKVQWWGIMPRLVWRWQQTRSNHPFYGDYTKRDVFIQLNKAF

SEQ ID NO: 245 - DNA, 1458 bp, K. denitrificans
atgatacccatcttccgccatcccaccattctggcactgtgcctgctcagccttccgctcggcacgattgccgcgccgccaaccctcgtgccgcacgatgacaatccgccatggccgcagccgccccagcccattcaaacggacgacagcatcgccccgaaaacaccccaaagcagtacccaaccctccaagcacctaaccgaaaccgacctgcgcgccaatcccgccctgaccgaacacctgatcaatcaggccatcctcagtcaccaatgggatttgctggccgacctgctggatttgtaccgcaccatgccgaaccacgataccgttttgtacgattacggcaaaggtgccctattgcgcgggcaggacaagcttgagcaggcaatcaggcattatgccgccattgtgcagcggcggccggaactgtcttatgtccggttcgactacatggcgatgctgtttgaaaaccaccaataccgccaggccgatcaacaggccgaacaattggaacagtccgacctgctgccggaagcaaaacaactggtggcgcaataccgccaagccatgcaaaaacggcaggcgtggcaagccgatgcctcgctgcaatacgaacggaacgacaacgtcaataacgcctcctctgcccgcgaactgcgcttgggctcacgcgtgtgggtgcgtgatgaagcctcgttgccccagaaagccaccggcctgcgttacagtgccgcgctcgaccgatccgtgaacattggcggcaaccacttcctcaccggcggtgttagtttggacggtgtgttttactgggatcggcgcgagtacaacgaagaaaacctacgtgtgcaggctggttaccgcttccgcaatatccgcagcagctggcagatacagccctataccgaattcagctggttttcaggtagcccatacagccgccaatacggcatacaggggcaatatagccgccaaatcggctcaaaatggcaaatcagcgtgatggccacccgcagttggcggcattaccgcagcaaaaacgttgcacaaagctacaacggcccgcaaacccaattaactgccaccgccgcctggatgcccatcgcaaacagcctgctctatatcggtttagactggctggaacaccaaacccgcgacccgtcggaagcctccgtccgacgcggcatccgcttcgggctgatgcgggaatggccgcaattcggcctgcgtgcagacatccgcttgggcaggcggcagttccgccaaacgcacttctttttccccgtggtgcgctccgaccgagaaacccagctcaacttgtcgctgtggcatcccaaactgcaatggcacggcctgatgccccgcctaacctaccgccatctgaacatcaacagcaatattccggaactctaccaacgccgcagccgccaatggtttatcgaggtggaacgtcggttttga

SEQ ID NO: 246 - protein, 485 aa, K. denitrificans
MIPIFRHPTILALCLLSLPLGTIAAPPTLVPHDDNPPWPQPPQPIQTDDSIAPKTPQSSTQPSKHLTETDLRANPALTEHLINQAILSHQWDLLADLLDLYRTMPNHDTVLYDYGKGALLRGQDKLEQAIRHYAAIVQRRPELSYVRFDYMAMLFENHQYRQADQQAEQLEQSDLLPEAKQLVAQYRQAMQKRQAWQADASLQYERNDNVNNASSARELRLGSRVWVRDEASLPQKATGLRYSAALDRSVNIGGNHFLTGGVSLDGVFYWDRREYNEENLRVQAGYRFRNIRSSWQIQPYTEFSWFSGSPYSRQYGIQGQYSRQIGSKWQISVMATRSWRHYRSKNVAQSYNGPQTQLTATAAWMPIANSLLYIGLDWLEHQTRDPSEASVRRGIRFGLMREWPQFGLRADIRLGRRQFRQTHFFFPVVRSDRETQLNLSLWHPKLQWHGLMPRLTYRHLNINSNIPELYQRRSRQWFIEVERRF

SEQ ID NO: 247 - DNA, 1539 bp, K. denitrificans
gtgaaaactattcgtaaaattatttcaggattggtattgggcatttcggtgggcgcggtggcggaacctttgccgcaaacggccgcagaacaggccggcgaatcgctgcaacagcaaccgtggctgcaatcgttggaggcggacggcgcgggtgaaaagcagcctgcacttgaacggaaaggtgctgcgcctgttgtggtgcgcaatcaggatttgcgcgaacaccccgaactgttggcggccatgctgcggcaggcggtggatgcgcgccacgagcctttgctcggcgcgctgctgcctacctatttgacgttgccgcaagagcagcaggacgcgaaacttcggcagcatgcgcaagccgaactggcacggttgcgcggagattatcccaccgccacggcgcattatcaggccgtgcagcggcaatatccggacgatgtgcgtttgcagttggactcggcggcaacgctggcggaagaccgacaatggcgcgaggcagaagccttgtttgcccaagcggcgcaaacgcccgaactgcccgacacggtggcggaaaacatccgcctgtaccgcaacggaatccgccaaaatacgcaatggcaggttcagggcggcgtgcagttgtcgtacgacaagaacatcaatgacgcgccgcaggcctattgcacgcctttgggctgcgtgcgcgaacggcaggaaaatgcgtgggggctgcgctaccgcgtgtatgccgaaaagaacacgccgattcgcggccatcacaacctgctgttccgcatgaatgcgtctgggacgacgtattacctgtcgcaacgcagcgcgtatgattatgcgttggcacgcgcatcgctgggctaccgtttccaagatgcgcggcaatcgctggaaattctgccgttttatcaggcgcaattttcaggcagccgccagttccccgacaaagcgccgcgacaaaagcgcgtgttgccgtatatgttggggcatgccgtcggggtgcaggctgcttttgaacggcagctcgcaccgaaatggacaggcttcgtatcgctggaaggaatgcggcaggatttccgcgaggcggaacgcgcgcgtcatcaaaacgggatggtgtggaatgcgtttgcatcgctgtcgtaccgcatccgcccgcagcatctcttgttcgcgggctacggctggggcagcctgcacccggacaacgacatggtgggcggccgcgccaattcttcgggctatgtgcggcacagcgtgcaggccggctggctggcgcaatggacggctttgggcaacctgaacacggaagtccgcgggcaatatacgcagcggcgctatcgcggttcggcattggacacggcgtttttgcggcggccgcagcgcaacaacgaacgttcgctgacggtggcgctgtcgtatccgaaatggcgcgtgtggggcgctgtgccgaagttggtttggcaggagaaccgcatcgacagcacgcacgattgggccgaccgcaggcagcgcaatgtgtggctggaatgggaaaagcggttttag

SEQ ID NO: 248 - protein, 512 aa, K. denitrificans
MKTIRKIISGLVLGISVGAVAEPLPQTAAEQAGESLQQQPWLQSLEADGAGEKQPALERKGAAPVVVRNQDLREHPELLAAMLRQAVDARHEPLLGALLPTYLTLPQEQQDAKLRQHAQAELARLRGDYPTATAHYQAVQRQYPDDVRLQLDSAATLAEDRQWREAEALFAQAAQTPELPDTVAENIRLYRNGIRQNTQWQVQGGVQLSYDKNINDAPQAYCTPLGCVRERQENAWGLRYRVYAEKNTPIRGHHNLLFRMNASGTTYYLSQRSAYDYALARASLGYRFQDARQSLEILPFYQAQFSGSRQFPDKAPRQKRVLPYMLGHAVGVQAAFERQLAPKWTGFVSLEGMRQDFREAERARHQNGMVWNAFASLSYRIRPQHLLFAGYGWGSLHPDNDMVGGRANSSGYVRHSVQAGWLAQWTALGNLNTEVRGQYTQRRYRGSALDTAFLRRPQRNNERSLTVALSYPKWRVWGAVPKLVWQENRIDSTHDWADRRQRNVWLEWEKRF

SEQ ID NO: 249 - DNA, 1434 bp, K. kingae
atgtattccaaactattacttaccagtgcgctgtggctggcaacggcatcgatttatgccgaaacgctgccacccaaagttgaacagatgctgaacgaatcgtcgcccgaaaccgaattcaatcgcacgcccgacatcaaacccaccgaaaacacgccacctacaaacgatgcggatggcgaaacactcaatatttcatcggaagaactgcaaaagcagcctgcacttttaaaacgcgctttttttggtgcattggcaacaggcaatgtggctggtgtcaaaattctgctgccctggtatcgcaatctaccagacggcaacgacgaatttgcgctcaatttagcagatgccatgctcgcgcaggacaagggcgattacgataacgcggtagaatcgtatcaaaaagtattggcacaacagcccgatgcgccgtctatccaaatgggactagcacaaactttgttcgccgaccaccgcaacagcgaagccaaacaaatcttgaccgaattgcacaatcgcagcgatttacccgaaaatttccgccaatacgcaggcagctatctgtccgccataaaaaaacgcaacgattggacatttaacatcaatgcgtattacacgcaagacaacaacatcaatagcacccccaatcaacgcaaagtcggcaactggacactgggtgaacccgaatcagcacacggcattgcgtattatggcaacgtcaataaagacacctatttgggcaaacaatggtcattgcgctttggcacagacgtgtttggcaaatattattgggacaaccgcaaatacgacgatttatcggcgcgtgtcaaactgggcgtagcgcatcaaaccgcgcgaagtgaaacagcgattttgccgtattttgaacgccgttggtatggtggcaaagaatacgctgccgaaaaagggctaacgctggaatggtcatactggttcacgcccaaaaatcaagttttgctgtcgggcgaacatagctggcaaaaacacgacacgcgctcatttttggacggcaaaaacagcaatttgtcggctacatggctgtttttatcatcagaaaaacaatactggacgctgggcatagacctgacccgcaaaaccgcgcaagacagcagcgacgcttatcgccgcaaaggcatacgtttaggctggacgcaatattggggcaacaccgtgggcagctcattgggcattggcactgcacaacgtgtttacgatgcgcccaacttcccgttcaactacattcgcaaagaccgcgaacattttgcatcgcttagcttgtggaacaaccgctggcaatttgggggcatcacaccacgcctagtattccgttggacaaaagtcagcagcaatcatccgttttacggcgattacagcaagaaaaatgtctttatccaaatgaacaaagccttttaa

SEQ ID NO: 250 - protein, 477 aa, K. kingae
MYSKLLLTSALWLATASIYAETLPPKVEQMLNESSPETEFNRTPDIKPTENTPPTNDADGETLNISSEELQKQPALLKRAFFGALATGNVAGVKILLPWYRNLPDGNDEFALNLADAMLAQDKGDYDNAVESYQKVLAQQPDAPSIQMGLAQTLFADHRNSEAKQILTELHNRSDLPENFRQYAGSYLSAIKKRNDWTFNINAYYTQDNNINSTPNQRKVGNWTLGEPESAHGIAYYGNVNKDTYLGKQWSLRFGTDVFGKYYWDNRKYDDLSARVKLGVAHQTARSETAILPYFERRWYGGKEYAAEKGLTLEWSYWFTPKNQVLLSGEHSWQKHDTRSFLDGKNSNLSATWLFLSSEKQYWTLGIDLTRKTAQDSSDAYRRKGIRLGWTQYWGNTVGSSLGIGTAQRVYDAPNFPFNYIRKDREHFASLSLWNNRWQFGGITPRLVFRWTKVSSNHPFYGDYSKKNVFIQMNKAF

SEQ ID NO: 251 - DNA, 1452 bp, K. kingae
atgcgccacttggctattttgacattactcgcgcccacttatttgcttgccaacacatttgatgcaccgccagtccccatagaaacaagcgcacccatcacgcgctcaactctcatttcgccaaccgaatcgcccgacgcgcaggctgctttgccgacttctgcacctgtcaaaaacatcacgctcaacgaacaagatttactccgcaatcgtcctttgttggaagagctgattggtcaagccatcaaaaccaaagacgcggcgtttttgcaagatttgttgtcgctgtatcaaaaacatccagagcgcgacctaatcttgcaagactacgcgcaaagtgccttgctttatctacacggcaagctcagtcaagctattgatttacaacaaaatttggttgagcaacaccccgatttgccttatatgcgaatgaacttggcaaccatgcaactggaagacaaacgctttgccgatgccgagcagcagtttgaacacttggcgcagcaaacagagcagcctgcacttcgcgccattgccaacgcgcacttaaaatcgttggcacatatgcagcaatggcagtttgacggacagttggaatatgaccgcaacaataatgtaaacaacgcatcggcagaacgtgaaatcgtcatcaatggtgcgcggctgcaaaaaagtgagcagtcgttacccaaatctgccgaaggtttgcgctatggcgtgtcggtgtcgcgttttgtaccgcttgctggcaaccatgcgctgtcgttttcgggtagcgtaaacgggcgacattattgggacaaccacgaatacagtcagcataatgtttacatatcaggcagttatatctaccaaaacaaaaactggacgttccgcaccacgccttttgcgctgcaatcgtggttgggcggcgcacgttatacgcaaagttggggcgcgagccaaagtgcggcgtatcaatttttgcctgcgtggcgtgtgcagttgagcgtgtcggggcgcaaaacgcgctatcacgatgcggatttgcgtgattttgacagccgttatgtgtcgcttacgcctgtgctggtgtattcgcgtcctacgtttggcgtgcattttggcgtgacggtgggcaagaatcaggcgcgaaaagagtcgctgtcgtctaaaagctggcaggtgtttggtggcgtgagcaaacagtttaattattttggcgcatcggcttcgctgtcgtacggcaaggaacgctacaaccaagcacccgaattgcgggttacgccctatccgtttcgccgagatgacaaaatcattcaaaccgatgtggcgatttggaatccaaaatggcattattggggcttgatgccgaagttgaatttttcgcgttatcaaatcgttagcaatatgcctgcgttttattcacgcaaaagccaacgtgtgtatttgagcgtggaaaagcggttttga

SEQ ID NO: 252 - protein, 483 aa, K. kingae
MRHLAILTLLAPTYLLANTFDAPPVPIETSAPITRSTLISPTESPDAQAALPTSAPVKNITLNEQDLLRNRPLLEELIGQAIKTKDAAFLQDLLSLYQKHPERDLILQDYAQSALLYLHGKLSQAIDLQQNLVEQHPDLPYMRMNLATMQLEDKRFADAEQQFEHLAQQTEQPALRAIANAHLKSLAHMQQWQFDGQLEYDRNNNVNNASAEREIVINGARLQKSEQSLPKSAEGLRYGVSVSRFVPLAGNHALSFSGSVNGRHYWDNHEYSQHNVYISGSYIYQNKNWTFRTTPFALQSWLGGARYTQSWGASQSAAYQFLPAWRVQLSVSGRKTRYHDADLRDFDSRYVSLTPVLVYSRPTFGVHFGVTVGKNQARKESLSSKSWQVFGGVSKQFNYFGASASLSYGKERYNQAPELRVTPYPFRRDDKIIQTDVAIWNPKWHYWGLMPKLNFSRYQIVSNMPAFYSRKSQRVYLSVEKRF

SEQ ID NO: 253 - DNA, 1608 bp, K. kingae
ttgcaggctgcttttttgcgtgaaaacactcaaaagcagcctgcaaaatatttaacactctgggtatatcaaatgaataaacagcatctattttggttatggttagctgtgagtctgtcagcagttgcagcagatgacgatgaactgcctgctccgtttgtagcaaagcgtacggacaataatgcggcagaagttatcgctattgcaaaagccccaaccaccacacacgctgacccacaagtattgcaacaaccgtttgacgatgtgaatacacaactggaatatgtgttagagccactgcccaattcagcacaaaccgagccgttgcccgaattagcgccattggaaatgcagcccaaagtcagcacgcaacaacaaatagacgaccaaatcaatcaagcgttgttggcaaaaaaatgggacgaactagaacgcttattagcaaccgagccacaagaaggatacgatgaaatcttgtgggtttatgccaaaggcacgttgttgcgtcaaaagcaaaaatattcacaggcgattgccgaataccgcaaagtggttgccacgcagccagaattgggttatccgcgtttggatttaggcattatgttgtttgaaaacaagcaatataacgaagcggaagccgaattgacccaagccaaagcggacattaatccagaagctggggcgcaaaaagtggcagatgcctacttatcgcgcatggaaaacgaacaaagttggcagcctagtatgggcttgcaatacacgcaaaccgataatgtaaacaacgcagccaatagcacggatttatattacaacggcagacattttgtaaaaaataccgatgctttgcccaaatcggcgcacggttttaactatcatttgggcgtagaaaaagacaccaatttagcaggtaatcattatgttagattgggcgtgagtggtagcggtgtgcattattgggataactcagattacgatgagaactctgtgcaattcaatgtgggctaccgttttcaaagttggcgacatcaatttggcgttatgccttttttcacgcaaaactggttgggcggagaacgctacaatcaacgctttggcgtaaccagcaattaccgctatcgctttaatccacaatggtctatttctgccgcgcatacttattccaacacgcaatatcataacgacagagttgcccaatattacgatggtcataacaacaacgtaggcttaacattgatatggaatcccacgcccagttggttgctgtttagcggtgtaaatggcagctacgacaatttgaacgacaaagcagaaagctccaaacgccgcagcattgtgagcggcatcgtgtacgataaccaacaatggggcggacgcgctaattttaattatgccaatcgccgcttccaaggcgcacactttttgtatggcaatcatcgtgccgacaaggaatatcaagtcagcgcagcggtgtggcaccataaattgtcgtggcgcaatattacgccgcgtttgaactatcgctatttgaaggtagatagcaatatgtctgcgctgtattcacgcaccagcggcgaatggtttattagtgcggaaaaaacgttccattaa

SEQ ID NO: 254 - protein, 534 aa, K. kingae
MQAAFLRENTQKQPAKYLTLWVYQMNKQHLFWLWLAVSLSAVAADDDELPAPFVAKRTDNNAAEVIAIAKAPTTTHADPQVLQQPFDDVNTQLEYVLEPLPNSAQTEPLPELAPLEMQPKVSTQQQIDDQINQALLAKKWDELERLLATEPQEGYDEILWVYAKGTLLRQKQKYSQAIAEYRKVVATQPELGYPRLDLGIMLFENKQYNEAEAELTQAKADINPEAGAQKVADAYLSRMENEQSWQPSMGLQYTQTDNVNNAANSTDLYYNGRHFVKNTDALPKSAHGFNYHLGVEKDTNLAGNHYVRLGVSGSGVHYWDNSDYDENSVQFNVGYRFQSWRHQFGVMPFFTQNWLGGERYNQRFGVTSNYRYRFNPQWSISAAHTYSNTQYHNDRVAQYYDGHNNNVGLTLIWNPTPSWLLFSGVNGSYDNLNDKAESSKRRSIVSGIVYDNQQWGGRANFNYANRRFQGAHFLYGNHRADKEYQVSAAVWHHKLSWRNITPRLNYRYLKVDSNMSALYSRTSGEWFISAEKTF

SEQ ID NO: 255 - DNA, 1698 bp, K. kingae
gtgagcgagattaagacaaagcagcctgcactttatgttgatgaaaaagtgcaggctgcttttttaggtgatttttctttgtatcgcaaaaaaatgaaagccattctcaaattgaatgctaaaataccgctatccaaacataaccgcatttttttgatgatgaccacacacaccaccccattcaatcgcaccatattaacgattttattattcggcggacttttatcgtcacacgtagcccacgccaacgacaacccgaccgaactcaaacagccagccgattccgcgcagcaaaaatcgtggctcaaccagcttaatcaacaagccaagcagcctgcaccgcaatcaggcagcgcaaatacatcgcccaatcatgtaaccgatgccgatttaatcaagcagcctgcacttttggcgcaactgttgcaacaagccttgaacacgcccgaaaccgagttgattcaatcgctggcaaacgcctatcgccaaaccgaaaaccccgatgctttgctgctggcgcgagcagacggcatggtgcttcgtggacaaaatcgcctgtccgatgccattgccgcctacgagcgcattgtgcaaacccacaacgacacgcgcacacgcttggatttggcagccatgcaatttgaaaacaaacaatggcgcgatgccgaccagcaatttgaatccgctaaacaaaacgaagccttgcccgatgcggtgttgcacaatgtggcgcgataccaaaacgcgattgcccagcagcaagcgtggcagtttgaggcaggcatcagccccattcgcaatcaaaacgtgaacgatgcgcccgaaaagccgtattgcttgtatggcatttattgcagcaccacgcgcccaattaaggcgactggtattggctattcttttgattttgcgaaacaatattcgctgcgtggcaatcattcgctggtgttgcgcggtcaggtaagcggcacgcattatatcaaccacgcgcaatataacgatgcgtttttgcgtgtgctggctggttggcaatggcaggacaaaacgcgcacgattggcgtgttgccgttttaccaagcgcaattttcgggcagcgataattttgatagcaagccgactcaatcgggtagggtgctgccgtatatgctggcacacggcaacggcttgcaactgaattatgcgcaacaatatggcacgcgctggcaaagttatcactcgctggaaggctatcgcacgttttaccgcgaaactgctcgcgcccaaaaacaagacggctggacgcacagcacttatcattcgctcgcctttcgcgccacgtccaatatgacgtggtttacgggctatcaatattcgcggttcgcgcccaaaaatcgcgatttggcaggcagtcgcaacaacgcggcattccaacgccacgctattagtttgggctggttgcaacgctggcaaactttgggcggattgaatagccgcgtggtgtattcgtatgccaaacgccgttattcaggcattgctacgctgagcaacgaagcgcaacgcaatcacgaaacttcgctgcaattggcgttgtcgcacgataaattgcaatatcgcggattgcagccgagcttgaatgtgcagtttaaccgcattcgcagcaatcggccgtgggcgcaacgcaaatcgcatacagtttatttgggcttggataagtcgttttga

SEQ ID NO: 256 - protein, 565 aa, K. kingae
MSEIKTKQPALYVDEKVQAAFLGDFSLYRKKMKAILKLNAKIPLSKHNRIFLMMTTHTTPFNRTILTILLFGGLLSSHVAHANDNPTELKQPADSAQQKSWLNQLNQQAKQPAPQSGSANTSPNHVTDADLIKQPALLAQLLQQALNTPETELIQSLANAYRQTENPDALLLARADGMVLRGQNRLSDAIAAYERIVQTHNDTRTRLDLAAMQFENKQWRDADQQFESAKQNEALPDAVLHNVARYQNAIAQQQAWQFEAGISPIRNQNVNDAPEKPYCLYGIYCSTTRPIKATGIGYSFDFAKQYSLRGNHSLVLRGQVSGTHYINHAQYNDAFLRVLAGWQWQDKTRTIGVLPFYQAQFSGSDNFDSKPTQSGRVLPYMLAHGNGLQLNYAQQYGTRWQSYHSLEGYRTFYRETARAQKQDGWTHSTYHSLAFRATSNMTWFTGYQYSRFAPKNRDLAGSRNNAAFQRHAISLGWLQRWQTLGGLNSRVVYSYAKRRYSGIATLSNEAQRNHETSLQLALSHDKLQYRGLQPSLNVQFNRIRSNRPWAQRKSHTVYLGLDKSF

SEQ ID NO: 257 - DNA, 1428 bp, K. oralis
atggaatgttttatgaaatatctgccttttttattgctgactgtaaccttttacacccaagccgcgcccgttgctacgccgcttaatcccgtggcggatttaaccgaggaacaaatccagcaaaccgaacgccaaaatcagcaaaagcaagcggcgcaaaatggtgaaaaaacatcggtttccatgacagaagaagagctgttgcaacgccctgatttgctcaaaaacgcgctggacacggcaaatgcgcagcacaatattgaaaacattcgttttttgctgccgttgtatcgcaggctgcctgccgagcagcaggattctgtgctggcgcgctattcggaagggctggtgtggctggcggatgataagcatgaggcggcggagaaattatttaacgaaattttggcggaacatcctgattacgcgcctgtgcgcttgcagttggcgttgagccagtcacaaaacggcaagcagcgcgaggcggcaaatgaattgaaaaccttgaagcaaacgcctgatttgcctgcgcctgtggcgcaatatattgaccagtttgacgcgcatttgcaaaaaagcaaggcgtggcagttcaacgccaatgcgtattatctgcaagacagcaatgtggggcgcacgcccgagcagcgcacttatggctattggcgttttgccgagcctaaatcggcgcacggcgtgggctatgagctatcggcgcaaaaaaccacgccgattaaggggcattgggcggcgcgggtgaatgcatcggcgtatggtaagttttattgggatgcgcacgattatgatgatttggttacacggctggaagcggggcctgtatggcgcgatgcgaagcaggaggtttcgttgttgccgttttatgagaaacgctggtatggcggcaaggcttattcctacacaacgggcggattgatgcgttattcgcgtgtgttgtcgcccaaatggcaggtgtttacggcgtggcagtcgggctataaaaagcatgataagcgcacgtttttagatggcgcatcgcatttgggcacggtgtcgctgctgtatcgcacgtcgccgtatcagtattttgtggtgagctggggcggcggggaaaattcggcgaaggataaatcggaggcgtatcgctttggcaatttgggcttgggctggaatcggcaatggggcagccagcatagtttgaccacttcgctgcatggtagcgtgcaaaagcgtaagtatcgcgcggaggattttttcaatatcaagcgcaacgagaaggagtatttcacgcgcttgtcgctgtcgcataaaaagctggcgtggcgcgggtttgagccgcgtttgaactggacgtggtcgcacgtggacagcaaccatttttattataagtatgacaatcatcgggtgtttttggatgtgtctaagcagttttaa

SEQ ID NO: 258 - protein, 475 aa, K. oralis
MECFMKYLPFLLLTVTFYTQAAPVATPLNPVADLTEEQIQQTERQNQQKQAAQNGEKTSVSMTEEELLQRPDLLKNALDTANAQHNIENIRFLLPLYRRLPAEQQDSVLARYSEGLVWLADDKHEAAEKLFNEILAEHPDYAPVRLQLALSQSQNGKQREAANELKTLKQTPDLPAPVAQYIDQFDAHLQKSKAWQFNANAYYLQDSNVGRTPEQRTYGYWRFAEPKSAHGVGYELSAQKTTPIKGHWAARVNASAYGKFYWDAHDYDDLVTRLEAGPVWRDAKQEVSLLPFYEKRWYGGKAYSYTTGGLMRYSRVLSPKWQVFTAWQSGYKKHDKRTFLDGASHLGTVSLLYRTSPYQYFVVSWGGGENSAKDKSEAYRFGNLGLGWNRQWGSQHSLTTSLHGSVQKRKYRAEDFFNIKRNEKEYFTRLSLSHKKLAWRGFEPRLNWTWSHVDSNHFYYKYDNHRVFLDVSKQF

SEQ ID NO: 259 - DNA, 1491 bp, K. oralis
atggcactccacactcccacccaaatgaataaactccctttgctcctgctccccctttccttgcttgcccttgccgacacgccaaccgcgctgaacggcgcgccgcctgcgcaccgaatcgccaacaagccgtcttccaacgcccccgctccccttttctttgacgaccgcgaaatcgcccttatccccaacgagatgctgccccagcctgccgagccggccgcgagccttgccgacaatgcgaccgaagacgacaacacgctggaagcgcaaatcaaccgcgccatcatcgcccgcgattgggcaacgctgcccgcgctgctggaacgctaccacgccgagccgcagcacgacccaacgctttacgattacgcgctgggtgcattgcgccgctcgcagttgcgccacgatgaagccaccgccctgtatcgcggcattgtgcaaaggcagcctgaattggcctatccgcgctttgatttgggcgtgatgctgtttgaagacaagcaatacaacgaagccaaacgcgagctggaacgcgccaagtccgatttgtcgcccgccatgcaagccgttgccgagcgttatcttgccgccattgcccaagcgcaaaattggcagcctgaaatgtcgctgcaatacgaaaccaccgataatgtgaacaacgccgccgatgcgcgcgaaattgaaatcaacgggcgcatttggcgcaaaaccgaagaaagcctgccgcaaagcgcgcaaggtttgcgctatggcttgggcgtggagcgcgagcgcaatttaggcgggcaccattttatttatgggcgcgttcatggcgatggcgtggcttattgggataaacatgaatacgacgagcaaagcgtgaatatcgcgctgggctacaaaaaccgcaccgtcaaacgcgcgttgggcatcgtgccgttttttgagcaaaactggctgggcggcagccgatacagccacaacgcaggcgtgcaggccgatttttcgcaccagctgggcaaacgctggcgcgtgatgctgaacgcgggctatatagccaagcgatacgatgagccctccaccgcacagcggtacaacggcaaaatgccgctggcaagcgccacgctgatgtattacgcgccgcaaaattggctgctgtatggcggggtggattggtcgcacgacatcacgcaagatgcggagcaggcttcggtgcgcaaaggcgtgcggctgggcacggcaaaaacgtttgccaacgggctgggattgcgcacacatttgcgttatgcacggcgcacgtttgatgcggcgggtacgctggtttatctgtatccccgccaagacgatgagtatcaggcgaatgtgtcgttgtggcatgacaaattgtcgtggaagagctttacgccgcatttgaatttccgctatttggcgattgacagcaatatgaaagggttttattcacgcaaaaacgcgcaatggtttttaagcgtggagcgggggttttag

SEQ ID NO: 260 - protein, 496 aa, K. oralis
MALHTPTQMNKLPLLLLPLSLLALADTPTALNGAPPAHRIANKPSSNAPAPLFFDDREIALIPNEMLPQPAEPAASLADNATEDDNTLEAQINRAIIARDWATLPALLERYHAEPQHDPTLYDYALGALRRSQLRHDEATALYRGIVQRQPELAYPRFDLGVMLFEDKQYNEAKRELERAKSDLSPAMQAVAERYLAAIAQAQNWQPEMSLQYETTDNVNNAADAREIEINGRIWRKTEESLPQSAQGLRYGLGVERERNLGGHHFIYGRVHGDGVAYWDKHEYDEQSVNIALGYKNRTVKRALGIVPFFEQNWLGGSRYSHNAGVQADFSHQLGKRWRVMLNAGYIAKRYDEPSTAQRYNGKMPLASATLMYYAPQNWLLYGGVDWSHDITQDAEQASVRKGVRLGTAKTFANGLGLRTHLRYARRTFDAAGTLVYLYPRQDDEYQANVSLWHDKLSWKSFTPHLNFRYLAIDSNMKGFYSRKNAQWFLSVERGF

SEQ ID NO: 261 - DNA, 1410 bp, Kingella sp. Sch538
atgaaaaaaacatctcttttattcctcacgctaaccgctaccgccgttcaagccgcgcccgttagcacccctttaaaccaaatccccgatttaaaccaagagcaaatcagccagcaaactgaaaccgttgtgcagcctgaaaacgccaagcaacattcagcgtccatgaccgcagacgatttgctcaagcagcctgaattattgcaaaacgcgctggatactgccatcaatcagcaaaatgtaaacaatatccgctttctgctgtcgatttaccgcaagcagcctgaaaaccagcaagatgccgttttattgaaatacgcagagagctttgtgcaacgcgcagacggtcagcaagatgaagcagaacaaaatttgcgtgaactggtgcaagcgcaccccgaatttgcgccgattcgtttgcaatacgcgctgactttgttgcaaaacggcgagcaaaaagaagccgcgcaagaagtcgccaaaatccgcgaaacgctcgaattacccgaagatgtcagccaatatctcaaccaatttgacgcgcatctgaaaaacgaaaaagcgtggcaattcaacgctaacgcgtattatttgaatgaaggcaacgtaggtcgcgcgcctgaacaacgcacttatggcaattggcaatttccagagcctaaaaaagcgcacggtttcggctacgagttatccgctcaaaaaaccgttcccattaaagggcattgggcggcgcgtgtgaatgcttcggtttacggcaaattttattgggatgcgcatgattacgatgatttagtcgcgcataccgaagcgggcgcggtgtggcgcaatgccaagcaagaagtgtctctgatgccgttttacgaaaaacgctggtatggcactgagccgtattcgcaaacttcgggcgcgattttgcgttattcgcgcactttgtcgcctagctggcaggtttatggtgcgtggcaatcagattacaaacgccatgatgaccgtctgcatttaaacggggctgaccattcggcttcggtgtcggtgctgtatcgcagcagtccgcagcagtattttgtgattggggctggggctgggcgcagcaacgcaaaagatttgtcggacgcgtatgtttacagcaatgcgcgtgtgagctggacgcgaaattggcgcagcctgaaaaatttatccaccactttgagcgtgtcggcacaacgccgcaattatcgtgcgcctgattttttcaatatccgcagacatgacaaggaatatttcacgcgcttatctgtgtctcacccaaaattatcttggggcgggtttgtgccgcgcttgaactggacttggtctcatgtgaatagcgaccatttttattatcgctataatcagaatcgggtttttgttgatgtgatgaagcagttttga

SEQ ID NO: 262 - protein, 469 aa, Kingella sp. Sch538
MKKTSLLFLTLTATAVQAAPVSTPLNQIPDLNQEQISQQTETVVQPENAKQHSASMTADDLLKQPELLQNALDTAINQQNVNNIRFLLSIYRKQPENQQDAVLLKYAESFVQRADGQQDEAEQNLRELVQAHPEFAPIRLQYALTLLQNGEQKEAAQEVAKIRETLELPEDVSQYLNQFDAHLKNEKAWQFNANAYYLNEGNVGRAPEQRTYGNWQFPEPKKAHGFGYELSAQKTVPIKGHWAARVNASVYGKFYWDAHDYDDLVAHTEAGAVWRNAKQEVSLMPFYEKRWYGTEPYSQTSGAILRYSRTLSPSWQVYGAWQSDYKRHDDRLHLNGADHSASVSVLYRSSPQQYFVIGAGAGRSNAKDLSDAYVYSNARVSWTRNWRSLKNLSTTLSVSAQRRNYRAPDFFNIRRHDKEYFTRLSVSHPKLSWGGFVPRLNWTWSHVNSDHFYYRYNQNRVFVDVMKQF

SEQ ID NO: 263 - DNA, 1605 bp, Kingella sp. Sch538
atgaatacacatcatctcttcttattattgttggctgcgagcttatcagcaaatgcagcagatgatgaagacttgcccacttccgccactgccaaacgcaaagaaaacaacacggtggaaaccatccccattgccaaagctgccacagccacgcataacgacccacaagtatttcagcagccgtttgatgatgtgaacacgcaagaagaatatgaattaaaaccgttgcccaatttgccaaaaaacgatttagcagacgtgcaacaggaatatgaattgcagccgttgccgaatccagcgaaaaaagatgttatccctgaattaacacagcctgaagcatcgcagcctgaaaaccaacaaaccagcacacaacaattagacgaccaaatcaaccaagcgttagtcgccaaaaaatgggacgagctggaaaaactattggcagtagaacagcaagcaggacaagacgaaacgctgcgagcttatgccaaaggcgcactattgcgtcaaaaacaagaatatccacaggcaatcgcagaatatcgcaaagtagtcgccgcgcagcctgaattgggctatccgcgtttagacttgggcatcatgttgtttgaaaacaagcaattccgtgaagccaaagccgaattaaccgaagccaaagcgcgtatcaatccagaagcaagagcgcaaaaaatcgtcgatgcgtatttagaaggtatggaaaaagagcaaagctggcagccgaatatgggcttacaatacacgcaaaccgataatgtgaacaacgcatcggatagcgtagaactgttttataacggcagacgttttgtgaaagataccgatgccttaccaaagtcagcgcacggtttcaactacaatctgggactggaaaaagacaccaacttagcaggcaaccattatgcacgagtgagcataaacggcagcggcgtacattattgggataactcggattacgatgaaaactcgttgcaattgagtgcaggttatcgctaccaaagctggcgttaccaactcggcttctcgccatttttcgcgcaaaactggctcggcggtgaacgctataatcaacgctttggcgtaaccagcaattatcgttatcgctttaatccgaagtggtcgatttccgccgcgcatacctattttaatacgcgttaccgcagcgataatgtcgccaaatattacaacggctacaacaacaatgtgggcttaacgctgatgtggaacccaacgccaagatggttgctgtttggtggcgtgaatgccagccatgacaagctaaaagacaaagccgaaagctcaaaacgcgcaggcttcaccagtggcgtggtgtacgataaccaaaaatggggtgcacgaaccaacttcaattttgccaaccgccgtttccaagatgcgcacttcttgtatggcagtcatcgtgcagacaaagagtaccaaatcagcgcagccgtatggcatcacaaattaacgtggcacggcatcacgccacgtttgaactatcgctatttgaaaattgatagcaatatgccagcactctattcacgcaaaaacggcgaatggtttatcagcgcggaaaaaattttccattaa

SEQ ID NO: 264 - protein, 404 aa, Kingella sp. Sch538
MNQALVAKKWDELEKLLAVEQQAGQDETLRAYAKGALLRQKQEYPQAIAEYRKVVAAQPELGYPRLDLGIMLFENKQFREAKAELTEAKARINPEARAQKIVDAYLEGMEKEQSWQPNMGLQYTQTDNVNNASDSVELFYNGRRFVKDTDALPKSAHGFNYNLGLEKDTNLAGNHYARVSINGSGVHYWDNSDYDENSLQLSAGYRYQSWRYQLGFSPFFAQNWLGGERYNQRFGVTSNYRYRFNPKWSISAAHTYFNTRYRSDNVAKYYNGYNNNVGLTLMWNPTPRWLLFGGVNASHDKLKDKAESSKRAGFTSGVVYDNQKWGARTNFNFANRRFQDAHFLYGSHRADKEYQISAAVWHHKLTWHGITPRLNYRYLKIDSNMPALYSRKNGEWFISAEKIF

SEQ ID NO: 265 - DNA, 1416 bp, L. adecarboxylata
atgaatattttgcgtactggcgcactgagtttgctgtgcccgctcagcgttgcgtttgctgcgccgccggaaaccgactcgattcctgctgctccccactttgaacgactggccacgccagagaagcgcaccgcgcctggcgataaaacgctgcatgtgaccaatgcgcaactggcggaacagcctgagctggcgatggcgctgctcgatcaggccatacgcgaagaaaagtggccgatggttcgtgccatattaccagtctatgcggcgtcaccgaatcctgattctaccctgattcattttgccaaagctggccttgcgcgcagtcaggggaattatgcagaggcgattgaacactatcgcgccattctgagtcgtcatcctgactttgctgcagtgcgtctggatttagcgcgtgccatgtttgaaaatcgtcagtttgacgcggctgattatcagtttcgtcgtgtattacaaagcaatccgcctgagaatattcagcaggttattgcacagtatcttgagcgcattcagaaaggcagcgcattgacgggttcattcagcgtgagttatttgaatgacagtaatgtgaataatgcatcatcgggtaaaaccattcgggttggcgatcgtctgtttattcgtaataaggatagtttcccacagcgcggagaaggtttctggttcaatggcgcattacaaaaagatgttcagctctttgatcagcatggcttgcgatttcttggtacggtaaacggtaaaagttactggaataatcatgattttgatgatgtgactagccgggcttatgccggatatcaatggcgtaatttccggcagcaatttgccctgttgccgttttatgaaaaaagatggtatggcaccgaggcctattcttctggccccggcgtccgcgcggaatacagttatttactgacgcccacctggcaggtgagtcaggcgctggaatatcagaaactggattatgatgatgaagattatcgcttcttgcgcggtcaaaatcgttactcttccacaaccctgtcccatgccttcagtaaccgggtgtcaggctttgccggcgtcgatctgcttgagcagcagacctccactcgcagtgaatctaaccatcgggtcggtttgcgcagcggggtgcaggttgatatgccctggcaactctcttttgccgccaccacggccattgccagacgcaattaccaggccgacagtgatatcttttcgacgcgacgcaaagataacgaacagatctataacctctcgctctggcatcgcgacctctatttctttggggtgatgccgaaactgaatttcagctataagcgggtcgatagcaatatcaatttctatgattatcaacagaggtatatcacgctttctctggataagaatttttaa

SEQ ID NO: 266 - protein, 471 aa, L. adecarboxylata
MNILRTGALSLLCPLSVAFAAPPETDSIPAAPHFERLATPEKRTAPGDKTLHVTNAQLAEQPELAMALLDQAIREEKWPMVRAILPVYAASPNPDSTLIHFAKAGLARSQGNYAEAIEHYRAILSRHPDFAAVRLDLARAMFENRQFDAADYQFRRVLQSNPPENIQQVIAQYLERIQKGSALTGSFSVSYLNDSNVNNASSGKTIRVGDRLFIRNKDSFPQRGEGFWFNGALQKDVQLFDQHGLRFLGTVNGKSYWNNHDFDDVTSRAYAGYQWRNFRQQFALLPFYEKRWYGTEAYSSGPGVRAEYSYLLTPTWQVSQALEYQKLDYDDEDYRFLRGQNRYSSTTLSHAFSNRVSGFAGVDLLEQQTSTRSESNHRVGLRSGVQVDMPWQLSFAATTAIARRNYQADSDIFSTRRKDNEQIYNLSLWHRDLYFFGVMPKLNFSYKRVDSNINFYDYQQRYITLSLDKNF

SEQ ID NO: 267 - DNA, 1296 bp, L. oryzae
atgagtgcattggcactcgccatcgcgctacttggacaatccgcctgtgcaggcgatatgtccacactactgcagtccgctaaaacgcaaccggcggatgaagcctatcaattgctatctgcggaagaagcacaatttgcaggtgaaccagacttcgactatgcccttggggtagcggcactagaaagtggccactacaccgcggccagctttgcgctggaacgcgtcgtcgcaaacgaaccggacaatgcagccgcctatctggatcttggccgggcctactatggcatgggtgatctggacgctgccaaaacggcctttgacgaggtagcctcccataatccgccagaagcggtacgcaagctgctgcaaagctaccaaggacaactcacaccacctgccagcagcgaactgaaggcaatgatctatatcgggacggggcatgacagcaatgccaatggcggattaagccaagacatctatacattccccgcagcacctgctctcccagtcacaatgccgtcaacagcattggccaagtccgacaattacgcttttgcaggagcgcagctctcttaccggacagtgatcagtaatggcctcgttctggacgccagcctgaatgcggcaggcaaatcctttgatcagctagacactcaggacagtcataccatcggactcggtggtggcctgacctggcaaacgggagataaccggctacggcttggcgtcaataccagcaaagagtggctgaaccatcaacactacgtcactacggatggcgcacggatcgactggtcccacctgctggatagccaaagcgaaatctccttgtatggcaactacaaccggtatgactacacctcatccgggagtgatgttcatcgtgtgacattaggcagccgtttcatgcaaagctttgaggatctgccttacaaaccactcttgcaaagcggtttctatgcaggcaaaaccctgacagatgctggaacacctgactatgtcggtaaccggttcttcggtttcatgctgggtggcatctggcataccagcgagcaaaccgacatttacctctccggtgcttatgagagacgcatctattcggccgatacacccgcctatctggctcggcgaaaagacaatcaatgggatatccggctaggcatgaactaccgcttttacccacgcttcacgttgaccccgcaaatcagctggacccgcaatggcagtaatcaggatatcagccaataccagcgcaccaggtttgatctgacgttaaagtatgatttccagtaa

SEQ ID NO: 268 - protein, 412 aa, L. oryzae
MSTLLQSAKTQPADEAYQLLSAEEAQFAGEPDFDYALGVAALESGHYTAASFALERVVANEPDNAAAYLDLGRAYYGMGDLDAAKTAFDEVASHNPPEAVRKLLQSYQGQLTPPASSELKAMIYIGTGHDSNANGGLSQDIYTFPAAPALPVTMPSTALAKSDNYAFAGAQLSYRTVISNGLVLDASLNAAGKSFDQLDTQDSHTIGLGGGLTWQTGDNRLRLGVNTSKEWLNHQHYVTTDGARIDWSHLLDSQSEISLYGNYNRYDYTSSGSDVHRVTLGSRFMQSFEDLPYKPLLQSGFYAGKTLTDAGTPDYVGNRFFGFMLGGIWHTSEQTDIYLSGAYERRIYSADTPAYLARRKDNQWDIRLGMNYRFYPRFTLTPQISWTRNGSNQDISQYQRTRFDLTLKYDFQ

SEQ ID NO: 269 - DNA, 1509 bp, M. aminisulfidivorans
atgatttttgatgtataccaatcttatcgttatcccatatcagtgtggatagcatttttgtgcctgaccgttttatcgatcaccagtcagaacagttgggcagatgataaagacacgtctctccgcttaaaccaaggaatcgagttacgcgctgatcaacaagagcaggaaatcctgaaagatgaggactatttgcgaggtgaacggcccagtttaatcattgatggtcagtcatacaccgttcagcacaacagtaatgatgtcggccgtgccttgtatgtgtcattgcagaaaaaacagtggtcgtcggtgaagttttttctgcaagaatatgaagaatttgctgatgcagatcctatgctgctcgcctatgcacggggtgctattgcacgaatggaaggtgatctggaacaggcagaaacagaataccgccagcttatcgacttaaaacccgactttttgcccggtcagttagaactcgcgcgcgtgctgtttgaaaataggaaagatgcagagtcagatcaggtgtttggcagcattcaacagacattaaatcctgccgatgcacgtcagcaaggcgttagcaccacggtagatagttttttgcaggctttagataaacgccagtcatggcaaggttccttttccattggcccaacctgggtcgataacttaaaccaatcctctgaaagctacagttgcttactctattttggcaatgtctgcttttacgaacgtgagacacccgaagcggtgaaagcacatggcctggattacgaagccacactgaataaacgatttgctttatcaggccatcatggtgtgtttttccgttcattattatttggtcaaagttataaagatcattctgacttcaatgaaagccaaatcacctcacagctaggctatagctatcacgctcaacgtaatcagttttcattcgccccttcttttgatttctcacgttatggtcagcgctccatgtatggtgcctggggtttacatagtgagtggttacattatgtgtctgatcgtatgctgtttaaactcgaagccgactacaaagatcagcagtatcgacaagaagactatgctgcttataacggtgatatctggtcagcttacgccaccgcctggtatgtatttcctcacctctggactgtctttggcggtgtggactggacgcaaaaacaggctgaagtggaaccctatgcctatcagcaaataggcatcagagctggtctgtccaaaaaattcaatgaagacattaacgccgtgctttttgcctctgtgcgtcaacgcaaacatgatgaatttaatgccttacttggtgagcagcgtgaagatattgagcaaaactacacacttatcgtgcgtttccccggactgagtttttatgggctggaacctaatctcaccctgaagcatcgaaaagtgcatagcaatgtgaactggctttattcctatgaacgtaatgctgtgagcctccgacttgagaaacaattttaa

SEQ ID NO: 270 - protein, 502 aa, M. aminisulfidivorans
MIFDVYQSYRYPISVWIAFLCLTVLSITSQNSWADDKDTSLRLNQGIELRADQQEQEILKDEDYLRGERPSLIIDGQSYTVQHNSNDVGRALYVSLQKKQWSSVKFFLQEYEEFADADPMLLAYARGAIARMEGDLEQAETEYRQLIDLKPDFLPGQLELARVLFENRKDAESDQVFGSIQQTLNPADARQQGVSTTVDSFLQALDKRQSWQGSFSIGPTWVDNLNQSSESYSCLLYFGNVCFYERETPEAVKAHGLDYEATLNKRFALSGHHGVFFRSLLFGQSYKDHSDFNESQITSQLGYSYHAQRNQFSFAPSFDFSRYGQRSMYGAWGLHSEWLHYVSDRMLFKLEADYKDQQYRQEDYAAYNGDIWSAYATAWYVFPHLWTVFGGVDWTQKQAEVEPYAYQQIGIRAGLSKKFNEDINAVLFASVRQRKHDEFNALLGEQREDIEQNYTLIVRFPGLSFYGLEPNLTLKHRKVHSNVNWLYSYERNAVSLRLEKQF

SEQ ID NO: 271 - DNA, 1266 bp, M. caprae
atgctttcagtggatgaacagatgctactgaccaacccaaccttactgtctcgagcaatgctttcggtgctggtggctaatgatgtggctggaactcagttattattgcccatctaccaaaaacagccgagtgaaatcattgaatctgaaatggttgactggggcagtgccgtgctggcaggtgcggaaagcagacatggtcaagccagcaaaatctaccaatttttgcataaccaataccccaataatgatctttttgccgttagactgattcagagtttgtttgccaatcgtcaatatctagaagccaaacaactgcttgcagagcaaccagattatattgtccgtgaaatgcgtgcctaccaaaaagccttaacaaatttaaccaagccatcggtgtatttttctggcaatgtaattgttgataaaaacattaacaatgcacccaatcagaccgatttgggtggtggctggacggcaaacgctgctgagcaagcacatggtgtcgccatcaatgcaggtatggaaaagaaagttttactcaaaggtggcatgacgctagaaccttctgttacgatgagtggcaagctctttcgtgatgctaagcattataatgaaacgcagcttcgcctaggggtcaacactgtcaaaaaccatactgggggtagcttatctgtttcgccttttgtggagactgcttggtatgctggtggtaaaaagggtgttaatgaattaaagcatttttcggacacgctgggtgtgagtattggcagtcaaagacagcttggtaaaaaaagccagcttgctactaatgttgaatttgccaaacatcatcataacatcagacatcatttatcaggtcatagtgtcagtgccaaagcgagcttttctacgcgtcctaactggctgggagaaagtggttgggtcagtgttggtgcagattatcgacaggcaaaaacccgggataaagatgactcctatacccgtgtcggcatacaaggttcaattaccaagcggtggcatgatttcggtgtgagtggcagtttgaatttttcccaaagacgctatcatggaccgatgccgatttttaatcaaatacaaacaagtgatgagtattttaccaacatcagtgtttggcataataagctgagctacttagggctaacgccgaaattgacttggcaataccaaaaaaatgacagcaacatcgcactgtacaactacgataaaagtcgtgtgttcttagaggtgagtcgccaattttaa

SEQ ID NO: 272 - protein, 421 aa, M. caprae
MLSVDEQMLLTNPTLLSRAMLSVLVANDVAGTQLLLPIYQKQPSEIIESEMVDWGSAVLAGAESRHGQASKIYQFLHNQYPNNDLFAVRLIQSLFANRQYLEAKQLLAEQPDYIVREMRAYQKALTNLTKPSVYFSGNVIVDKNINNAPNQTDLGGGWTANAAEQAHGVAINAGMEKKVLLKGGMTLEPSVTMSGKLFRDAKHYNETQLRLGVNTVKNHTGGSLSVSPFVETAWYAGGKKGVNELKHFSDTLGVSIGSQRQLGKKSQLATNVEFAKHHHNIRHHLSGHSVSAKASFSTRPNWLGESGWVSVGADYRQAKTRDKDDSYTRVGIQGSITKRWHDFGVSGSLNFSQRRYHGPMPIFNQIQTSDEYFTNISVWHNKLSYLGLTPKLTWQYQKNDSNIALYNYDKSRVFLEVSRQF

SEQ ID NO: 273 - DNA, 1512 bp, M. catarrhalis
atgacaatcacgcctgtttataccacattcacccccaccaaaacacccataaaattttttatggctggcttgacttttctaatcgctcatatcagccatgccgatgatggtcgcaccgacaatcaagagccaatcaatcaagaaatagccacccttgaacccatcattaaccatgctcagcctgagttattgtcccatgatgcattaacaccaaaaatagaaccaatactggcacaaacaccaaatcctgccgaagatacgctcatcgccgatgaggcgttactgcttgataaccctgatttgctcaatcacgccctaaattctgctgtcatgaccaatcatatggcaggcgttcacgcattattgcccatttatcaaaaactgcccaaagaccatcaaaatggcattttacttgggtatgccaatgccttggctgctttggataagggcaacgccaaaaaagccattgatgagctgcgtcgcatcatcgccatcatgcctgaatataatgtggtgcgttttcatctggcaagggcattatttatggacaaacaaaatgaagccgcccttgaccagtttaataaattacatgctgacaacttgccagaggaggtgcggcaggttgttgggcagtacagacaagcgttaaaacaacgagattcatggacatggcaagtaggcatgaatctggccaaagaagacaacatcaatcaaacccccaaaaacaccacgcaaggtcaatggacttttgacaaacccattgacgccatcaccctaagctaccaattgggggcggataaaaagtggtctttgcccaaaggggcatatgtgggagcgaacgcccaaatctatggcaaacatcatcaaaatcacaaaaaatacaacgaccattggggcagactgggggcaaatttgggctttgctgatgccaaaaaagaccttagcattgagacctatggtgaaaaaagattttatgggcatgagcgttataccgacaccatcggcatacgcatgtcggttgattatagaatcaacccaaaatttcaaagcctaaacgccatagacatatcacgcctaaccaaccatcggacgcctagggctgacagtaataacactttatacagcacctcattgatttattacccaaatgccacacgctattatcttttgggggcagacttttatgatgaaaaagtgccacaagacccatctgacagctatcaacgccgtggcatacgcacagcgtgggggcaagaatgggcgggtggtctttcaagccgtgcccaaatcagcatcaacaaacgccattaccaaggggcaaacctaaccagcggtggacaaattcgccatgataaacagatgcaagcgtctttatcgctttggcacagagacattcacaaatggggcatcacgccacggctgaccatcagcacaaacatcaacaaaagcaatgacatcaaggcaaattatcacaaaaatcaaatgtttgttgagtttagtcgcattttttga

SEQ ID NO: 274 - protein, 503 aa, M. catarrhalis
MTITPVYTTFTPTKTPIKFFMAGLTFLIAHISHADDGRTDNQEPINQEIATLEPIINHAQPELLSHDALTPKIEPILAQTPNPAEDTLIADEALLLDNPDLLNHALNSAVMTNHMAGVHALLPIYQKLPKDHQNGILLGYANALAALDKGNAKKAIDELRRIIAIMPEYNVVRFHLARALFMDKQNEAALDQFNKLHADNLPEEVRQVVGQYRQALKQRDSWTWQVGMNLAKEDNINQTPKNTTQGQWTFDKPIDAITLSYQLGADKKWSLPKGAYVGANAQIYGKHHQNHKKYNDHWGRLGANLGFADAKKDLSIETYGEKRFYGHERYTDTIGIRMSVDYRINPKFQSLNAIDISRLTNHRTPRADSNNTLYSTSLIYYPNATRYYLLGADFYDEKVPQDPSDSYQRRGIRTAWGQEWAGGLSSRAQISINKRHYQGANLTSGGQIRHDKQMQASLSLWHRDIHKWGITPRLTISTNINKSNDIKANYHKNQMFVEFSRIF

SEQ ID NO: 275 - DNA, 1626 bp, M. catarrhalis
atgacctgtttaccaaagaccaaccctgctttaaaagtcaagcacagatttttaaagcaggtgctgttattgctttgtgttgatacattaacagcacaggcgtacgcccacagccatcatacgcccattcatacacccacgcatgagctgccatctgctgatgctttatcagatgaaggcttgggtaaggatttgggcagtttggacagtttggatagcccagatggtttaggtgatggtttaggcgatggtttgggtgatggcttaaaaagtgataaaacccctttacccatcaacgccttgaccgcccatcagaccaatgagagccagcctgccccaccgagcgtagatgtcaattttttacttgcccagccagaggcattttatcatgtctttcatcaagcgattgtgcaagatgatgtggcaacattacgcttgttattgccattttatgaccgcctgcctgatgattatcaagatgatgttttgttgttatttgcccaaagcaaacttgccctaagtgatggtaataccaaactggcattaaatctgctgaccgatttgagcaacaaagagccgacgcttacggcggtgaaattacaacttgcctctttgcttctgaccaacaagcacgataaacacgcccaaatggtgctagatgaactcaaagatgatgcccactttttaaaattaagcaaaaaagagcaaagatgggtgctatcgcaaagtcgctatttacataaaaaatataaaatgggcttggatttgggcatcaactatctgcatttggataatatcaacgccgcctccaccatcacccagcccaacattaaaaaagatgccccaaaacctgctcatgggcttgccttatcgcttggtgtgaataaatacacgccgcttagtcatggcatgagtatttatacagccctagatgttgatggtaaattttatgatgacaaaagccacaatgaactggcggtttttgctcatgctggactaagaaaagatcaccaaaaaggttatgttgatgtcgtaccttttgttgggcgtatttttgccaccaatcagcagcatggcagattatcccccagaaaagacagtcagggcgtggcgtttggcagccatcatcggatcaatgataaatggcaaaatgcgttttttgcacgcatggaaaaaggcaattataccgagcgttatcaaggttatgatggcaagcgttatcatgtgaatgacaccattttgttgcaagatggcccaaatcgtcgttactctttgggcgtggggtatcagcttagccatctgcaagatgcaacaaaaagcagtcatgccacaaagatacattttggggtgttgcaaagattgccaaatggtctgaccgtgcaaggtagagtgagtgctgagcgtgagcgttatcatggtaaattattgcgtctggttaatcctgatgatgtgtatcgcacagataaaaccctaaccctacaaacctccatttggcacaaagacattcactggcttggattaacgccaaagctgacttatcgttacagtaaaaataacagtaacttaccagcactttatagccataacaaacaaaatttttatttggagcttggtcggtcgttttaa

SEQ ID NO: 276 - protein, 541 aa, M. catarrhalis
MTCLPKTNPALKVKHRFLKQVLLLLCVDTLTAQAYAHSHHTPIHTPTHELPSADALSDEGLGKDLGSLDSLDSPDGLGDGLGDGLGDGLKSDKTPLPINALTAHQTNESQPAPPSVDVNFLLAQPEAFYHVFHQAIVQDDVATLRLLLPFYDRLPDDYQDDVLLLFAQSKLALSDGNTKLALNLLTDLSNKEPTLTAVKLQLASLLLTNKHDKHAQMVLDELKDDAHFLKLSKKEQRWVLSQSRYLHKKYKMGLDLGINYLHLDNINAASTITQPNIKKDAPKPAHGLALSLGVNKYTPLSHGMSIYTALDVDGKFYDDKSHNELAVFAHAGLRKDHQKGYVDVVPFVGRIFATNQQHGRLSPRKDSQGVAFGSHHRINDKWQNAFFARMEKGNYTERYQGYDGKRYHVNDTILLQDGPNRRYSLGVGYQLSHLQDATKSSHATKIHFGVLQRLPNGLTVQGRVSAERERYHGKLLRLVNPDDVYRTDKTLTLQTSIWHKDIHWLGLTPKLTYRYSKNNSNLPALYSHNKQNFYLELGRSF

SEQ ID NO: 277 - DNA, 1449 bp, M. flagellatus
ttgaaagcccttctattccctctgattgtcctttgtctatcatccacggcatgggccaacgatttcttcgataatagtgccaaccaatggcaattcaacgaccaggcgcgcgaacggctggataatcgccgtaaccagcctacgcttgaggagcagattcaggcagagcctgcgattatgctaggtgatgatcaaaacagcaccgcaacattggcgcaggaaattttcgtccagatcaaccagcagaactgggtcaaggtcaagcaactgctaagctattacctggtttccccgcaccgcgaccccagcctggtggcgtatgcagaggctaatctagctgaagcgcagggcaacctgtccctggcattggagaaatacgagcggacattgtcgtatcttccggatttcacgcgcggcaagatggattatgcgcgagccttgttcaagaatggcgaggacaaggaggccaaacagatttttctttccgtcatgacgcccgatctccccttgccggtgcagcataatctcaatttatacctagatgcgcttgaaaggcgcaacgagtggaagttttatgccgcgctggattatttcaaggatgacaatatcaacctgacttccggggcgtcgctctgtctgctctcaatcagcagtgatctatgtgcggcccgatggtctgcgccaggggcattgccgagccatggagtgaactatacgttcactgcggagaaattcacgcccttaaaaggccgccatgggttgatgttccgctcgctggtctatggttcggactatacgcaggataatctgtacaacatcgggatggcgaacatggcgcttggctatgcttatcgcacgcccaaccatcgcttgtttatcgcccccacctttgaagcctattggcagagcaaccgcagactctacaccgcaggcggcatgatggcggagctgcgtagccagttgacgccgaggtggcagaataccttcagcatcaactggcaggatatccagtatgtgagggaggaggaaagggacaacgacgccaagcaatatttggtgacgctgaaccagttatatgcgttatccgacaagacattgctgttcggcggtgtggactatatccgtcgtaagctggatcctttccccatggcgagcttcgagcgttctggtgtgcgggtggggatgtttcatactgttagctcatggtttgacgtgaccatgtcagcctccaggcgctggcggaaatatgatgaatacaatccgatatacggcgggttgcgccaggacaccgaggatttctacagcctggcattggggttcccccgtttgcaggtgcaaggtgtcaagccttcactgtatgtgcagcatttcgatactgacagtagcttaccgctgtttttctcctatcgccggacgcaggccgggatcaggatggagaagtcgttctga

SEQ ID NO: 278 - protein, 482 aa, M. flagellatus
MKALLFPLIVLCLSSTAWANDFFDNSANQWQFNDQARERLDNRRNQPTLEEQIQAEPAIMLGDDQNSTATLAQEIFVQINQQNWVKVKQLLSYYLVSPHRDPSLVAYAEANLAEAQGNLSLALEKYERTLSYLPDFTRGKMDYARALFKNGEDKEAKQIFLSVMTPDLPLPVQHNLNLYLDALERRNEWKFYAALDYFKDDNINLTSGASLCLLSISSDLCAARWSAPGALPSHGVNYTFTAEKFTPLKGRHGLMFRSLVYGSDYTQDNLYNIGMANMALGYAYRTPNHRLFIAPTFEAYWQSNRRLYTAGGMMAELRSQLTPRWQNTFSINWQDIQYVREEERDNDAKQYLVTLNQLYALSDKTLLFGGVDYIRRKLDPFPMASFERSGVRVGMFHTVSSWFDVTMSASRRWRKYDEYNPIYGGLRQDTEDFYSLALGFPRLQVQGVKPSLYVQHFDTDSSLPLFFSYRRTQAGIRMEKSF

SEQ ID NO: 279 - DNA, 1329 bp, M. flagellatus
atggcgggagtgatcctgttgttgatgggcgaagggctagcttgcgcgcatgatacggccttgctcgacaaggcaggccgcttgatggccagccgtgactatgctgcagcctatgctttgctggagccggtggagtccgagtattccggcgaccctgcatatgacatgctattcggcctggcggcgattgacagcggtcatgtgacgcgcggcgtgttcgcgcttgagcgcgtgcttgcggtccagccgtataacggcaatgccagggcgcagattgcgcgcgcgtattttcttctgggcgagcaagaagctgcccgcgctgagttcaggaatgtgctcaaccagcaaccgcctgaagagatcacccaggtgatcaatcgctacatgagcgcgatcgacaaggcccaggggttgacgacggcattctctgcgtatcttgaaggcggagtgggtcatgattcgaatgtgaacagtgccacggccgccagttctgttaccgtcgctgtccctgcgctgggcggcttgattgtggatattggccttgaccgtcaagcccgcgagtcgagcgataactataccaatcttgctggaggcatttcgtttcgcaccccattggcaagacggtttgcgttgtttgccggtatcaatgcgtctcagcggttgaatcggcatcaggatgcctttgatctgggaatgctggatgcgaatgttgggctgagttatcgtcagcaccgggatacctataccgtagccgcgcaggcgaatagcctcagcctcgatgaccagacttatcgtcgggcatacggcatcaacatgcaatggcagcgcgacattgataccaagaatcaagtcaacctgtttgcccaggtttcgcgcctggcctatcccgacaacaggattcgggatgctgaccgatatattgtaggcggagggtgggctcatgtcttcgatggggacctgacgcctttattgtttgtgagtggctatggaggaaaggaacaggcaaggaacgagtatgcggacttcctcagctatcgtgtccatggtgtgcgcagcgggggccagctgactctcaggccgaatcttgtcgcgttcacaacattgggatacgagaaccgccgacatgatgagccggaaacattcccttttcttttcgcgacacgcgaggacaagcagctggatgccagtgtgggattaaggtatctgccgggatacaattggattatcaagccgcaattcacttttattcgtaatgactccacggttgaactctacagctttgaccgttatatggtctcggtcagcgtccgacgtgagttcaactggtag

SEQ ID NO: 280 - protein, 442 aa, M. flagellatus
MAGVILLLMGEGLACAHDTALLDKAGRLMASRDYAAAYALLEPVESEYSGDPAYDMLFGLAAIDSGHVTRGVFALERVLAVQPYNGNARAQIARAYFLLGEQEAARAEFRNVLNQQPPEEITQVINRYMSAIDKAQGLTTAFSAYLEGGVGHDSNVNSATAASSVTVAVPALGGLIVDIGLDRQARESSDNYTNLAGGISFRTPLARRFALFAGINASQRLNRHQDAFDLGMLDANVGLSYRQHRDTYTVAAQANSLSLDDQTYRRAYGINMQWQRDIDTKNQVNLFAQVSRLAYPDNRIRDADRYIVGGGWAHVFDGDLTPLLFVSGYGGKEQARNEYADFLSYRVHGVRSGGQLTLRPNLVAFTTLGYENRRHDEPETFPFLFATREDKQLDASVGLRYLPGYNWIIKPQFTFIRNDSTVELYSFDRYMVSVSVRREFNW

SEQ ID NO: 281 - DNA, 1449 bp, M. granulomatis
atgaaaaaaacactttttacttttttggctctttcgacaccttttgtattggcagatgataaaacgcagcaaattcaagagcaattagataaccaaagaatgcaacaaaaccggtatatggagcccgctgaacatcgcgttaagccattaaacataaaggctaaaaaccagggtaagagagtttccattactcctcaggagttatcaagacagcctcaactgcttaattcagcaatgctcacggcattagtcatgaatcacacacataatgtgatatttttacgacctatttatcagcaactgcctgaaaatgagcaaaatgaacagatcttattatgggctgaagcaatacaacaaaaatctgaacgtaactattcagactcaattcgcctatatcgtacgctcattgcacaaaacccacaaagccagcctattaggtttcaattagctactgccttgtttgagaatagagaaaccgaagctgcagaagaacaattccgcaaactccaaacagagcaattaccggcagaaattgctcatattattgagcagtatttaaacgcaatcaataaacaggataaatggaattttcaaggcggtctaacctatttaaatgatccgaatattaacaatgctccggattcaggcataacatataagggttggacacctcccaaaaaagaatccgcacaaggaattggctttaattttgatgctgataaaaaatggtcttggggtaatggtttcttccatcaattccgcctaaatggcaacggaaaatattattggaataacaaaaaatacaatgaatattctttgcgggaaagtctaggtttaggttatcaaaatgcgaagcacagaatcatatttctgccttttttagagcaaatgtggtatagcggtggttcaagccaaagcacaagcaccaaacgttattctaaagcaggtggaataaatgcccgctggcattattggctaacacctcaatggcaatcggtgctgaattacgaatacgctgagcagcgttatacacgccgcaaacatctaaatggtaactatcactttgttgcaccatcgctttattactatcctaacagccagcaatattggtttgttggtgcaaactttaaccgtaccagcactagagatttagacgacagctttattcgccgaggtcttaccttaggttggggccaagaatggaaaaatggattgtccagccaattaagcgtgagttatgctctaaaacaatatagaggtccaaactttttcaatatcatacaaaaaaacaaagagtacggtattcaagcaagtctgtggcatagagcagtgcatttttggggaattacaccacgtttaacatggagttacacaaaagtgaaaagcaaccacccattcaataattatgataaaaatcgcatataccttgatttttctcatacattctaa

SEQ ID NO: 282 - protein, 482 aa, M. granulomatis
MKKTLFTFLALSTPFVLADDKTQQIQEQLDNQRMQQNRYMEPAEHRVKPLNIKAKNQGKRVSITPQELSRQPQLLNSAMLTALVMNHTHNVIFLRPIYQQLPENEQNEQILLWAEAIQQKSERNYSDSIRLYRTLIAQNPQSQPIRFQLATALFENRETEAAEEQFRKLQTEQLPAEIAHIIEQYLNAINKQDKWNFQGGLTYLNDPNINNAPDSGITYKGWTPPKKESAQGIGFNFDADKKWSWGNGFFHQFRLNGNGKYYWNNKKYNEYSLRESLGLGYQNAKHRIIFLPFLEQMWYSGGSSQSTSTKRYSKAGGINARWHYWLTPQWQSVLNYEYAEQRYTRRKHLNGNYHFVAPSLYYYPNSQQYWFVGANFNRTSTRDLDDSFIRRGLTLGWGQEWKNGLSSQLSVSYALKQYRGPNFFNIIQKNKEYGIQASLWHRAVHFWGITPRLTWSYTKVKSNHPFNNYDKNRIYLDFSHTF

SEQ ID NO: 283 - DNA, 1302 bp, M. granulomatis
atcagattctccttcttattccttaccctttgtatcactcacacagtatttgctactaataaacctgatttagaagagcagttaaagcaagcggtttacctccaacgattagatgatattcagaaattattacaagagtatcaagagcaaactgattcagatccaaaacttattgcttatgcacaggcaaaatcggcgtttattcagcaagattattcaaccgctattgcgatttatcgcaaaataatcagtagtcaccctgagctaaattccattcgaatagaattagccatcgccctatttgcagatcgacaagataatgcatctaaatcacagtttgaaaaagtgaaagctgcttcaggcttgccagatagtgcgtatcagataattcaagcttatttagatacgataaatcagcgtaatgaatggcaatttagcctgaatttatcttactcgagaaccgataatgttgataatgtttctagcgattcaactatagagaatacaggttttaccaagcacaaaaatatgctgcctaaaaaagcacacggtattgcctataatattgatttcggcaaagattttaatttggtcggctcccactatttaagctttcataatgaaacaaacggcaaaacatattgggataatcaccgctttgatgatctttcaaaccgtattttggttggctatgcctataaaaagcaagatagcattttccggtttcaacctttctatgataaacgttggtatggtaatagctcttttcattggtcgaacggcatacagcttagttatgattttagactgtctaatcaatggcaaaatcaaacgttatttgcatttgagaagcggtcattttttgatgaaaatttgcaagccgggaatattaaaacagtatcaaatacacttatttggcaacccaaaccgcagcaactcttttatttaggtggagcaatttccaaagaaaacacgagagagaaacaatatggttcaactagccgaaatattcgcttgggatggttacaagaataccaatgggggatttctactcaattcagtttttcttttacccatcgaaaatttcacgatgaagcggtatttgcaagcattattcctcttaataaaattagacgcgatcatatttataatattaatgccaaaatttggaaacgagattggcatttatggggaattacaccaaaactgagttttgtttggaaaaagcaacgaagcaatttgaaaactttgtattcctactatgatcagcaactgaatttattatttgagaaaagtttttaa

SEQ ID NO: 284 - protein, 433 aa, M. granulomatis
MRFSFLFLTLCITHTVFATNKPDLEEQLKQAVYLQRLDDIQKLLQEYQEQTDSDPKLIAYAQAKSAFIQQDYSTAIAIYRKIISSHPELNSIRIELAIALFADRQDNASKSQFEKVKAASGLPDSAYQIIQAYLDTINQRNEWQFSLNLSYSRTDNVDNVSSDSTIENTGFTKHKNMLPKKAHGIAYNIDFGKDFNLVGSHYLSFHNETNGKTYWDNHRFDDLSNRILVGYAYKKQDSIFRFQPFYDKRWYGNSSFHWSNGIQLSYDFRLSNQWQNQTLFAFEKRSFFDENLQAGNIKTVSNTLIWQPKPQQLFYLGGAISKENTREKQYGSTSRNIRLGWLQEYQWGISTQFSFSFTHRKFHDEAVFASIIPLNKIRRDHIYNINAKIWKRDWHLWGITPKLSFVWKKQRSNLKTLYSYYDQQLNLLFEKSF

SEQ ID NO: 285 - DNA, 1407 bp, M. granulomatis
atgaataaaaaactatttctattgttgcttttttcgccttgggtaaatgctgaaactattgttgagtttcatcaagatccaaaagagtttaattatgatagacaagcggtcaaatttgagcaaaaagttgcaaaaaacagcttaaaatcaaccgcttacttgtctgagaataagacgactgaaagtatagaacaacaaattaaccaagcgattttaacgcaagattggataaggttagaaaaattactgacagattattcaacgcaaaaacaatttgatccattactgctggattatgcatcggctgccctagcctatgcaaaaaaggatcatcgttctgctattttttactatcggcagctgctgaaaaaacagccggagttaatctatccccgttttgatttagctttaattttaaaagaagattaccgctatagagaggcagagaaggaatttgaacagcttaaaacgactgctccacataatttacaaaccacagtgaattcgttgctaacccaaattcatgaagaagagagctggcagccggatttctacttgcaatatatccaaaccaataatgtgaataatgcagcctcatcccctattgtgaatgtaaacgggcgaattttccgtaaaagtgaggatagtctacctcaatcggcaaaagggataaaatatggtgttgggttaagcaaagtgcgaaatgtaggtggcaaccactttttaggaacagagcttgcttataatggtgtctattattggaataatcaggattatagtgagcagtcggtttctataaagccaagctatagttacagaacggcacattatcgtattgggttttcaccgtttatagaacagaattggctgggaagctcacgttataactaccagtttggcggaagaataaatgcgcttaaacgttttgaacaaagcttagtttcagtctcattcagccatttgcaaaaacgctattttgcccctaaaacggcagagcgccataatagttaccagaaccaagtaattgttggaacccaatggcaagcggttaaaaattggcgattttttgcaaatctgattgccagtcgtgaaattgcacgagaaaaagcacaatcttcaaataagtggttggcaaatgtaggcgtgatttaccaaactccaagttgggcaacctcagccagtttaggctatggaaaacgttattttgcggataaacattatttattcggctataaacggcaagataaggaatatcaagccaatattgcggtgtggaataaaaattggcattggcaaggcattgtgccgaaactgaattttcgctaccaaagaatagacagcaacattgctgatttttactctcgtagcaataaagaactcttttttacagtcgaaaaattattttag

SEQ ID NO: 286 - protein, 468 aa, M. granulomatis
MNKKLFLLLLFSPWVNAETIVEFHQDPKEFNYDRQAVKFEQKVAKNSLKSTAYLSENKTTESIEQQINQAILTQDWIRLEKLLTDYSTQKQFDPLLLDYASAALAYAKKDHRSAIFYYRQLLKKQPELIYPRFDLALILKEDYRYREAEKEFEQLKTTAPHNLQTTVNSLLTQIHEEESWQPDFYLQYIQTNNVNNAASSPIVNVNGRIFRKSEDSLPQSAKGIKYGVGLSKVRNVGGNHFLGTELAYNGVYYWNNQDYSEQSVSIKPSYSYRTAHYRIGFSPFIEQNWLGSSRYNYQFGGRINALKRFEQSLVSVSFSHLQKRYFAPKTAERHNSYQNQVIVGTQWQAVKNWRFFANLIASREIAREKAQSSNKWLANVGVIYQTPSWATSASLGYGKRYFADKHYLFGYKRQDKEYQANIAVWNKNWHWQGIVPKLNFRYQRIDSNIADFYSRSNKELFFTVEKLF

SEQ ID NO: 287 - DNA, 1395 bp, M. haemolytica
atgtataaaaaacattttctatttttacttgtttcgcctttagtaatggcggaaacggttgagtttcagcaagatcccaaagagtttgatgggcagcgacaagcggttaaatttgagcaagaaattgcaaaaaaggatttaaaattaaccgcttacttggaggaagataattctcttaaaggtattgaacagcacattaaccaagcgattcttagacaagattgggcgaagctggaaaggctgcttggcgattatgcaaagcaagagcaatttgatccgctacttttagactatgctttggcggcattggcttatgctaaaaaagattatcgctctgcggcgttttattatcagcagttgctgaaaaaacagcctgatttaacctaccctcgttttgatttggctctgattttaaaagaggattatcgctacagggaagcagagcaagaatttaagcaactcaaaaccgatgatttacgcaatgcggtgaacagtgcgttggctcaaatagaggaggaagagagctggaagccggatttttatttgcaatatactcaaaccaacaatgtgaataatgcttcttcgtcgccaacggtaaatgtaaacgggcggatttttattaaagaatcagacagcttgccgcagtcggcaaaaggcgtaagatatggcgttggcttgagtaaaatgcgaaatatcggcggtaatcattttgtgggagtcgatcttggctataacggcgtttattactggaataaccacgattatagcgaacagtcggtctcactaacaccaaaatatagctacagaacggcaacttatcgtatcggggtttcgccctttattgagcagaattggctgggtagctcacggtataactatcaatttggtagcagtatcaatgctgttaaactttttgaacgagggctgatttccggctcattcagccatctgcaaaaacgttatagtgaacagcatattgccgaccgttacaatggttatcgcaaccaactcacgctaggtacgcaatggcaagcggtcaaaaattggcgattttttgcaaatcttaacgctagccgtgaaattacccgtgagaaagctcaatcttccaataagtggctggcgaccattggcgtaatttaccaaaccccaagctgggcaagttcggtaagtgtcggatatggcaagcgttattttgctgataaacattatctgtttggctataaacgccaagataaggaatatcaagcgaatgtggcggtgtggaatcgaagttggcactggcaagggattgtgccgaaattgaatttccgttatcaaaaaatcgatagcaatattgccgatttctactctcgtagcaataaagaagtctttatgaccttagagaaactattttaa

SEQ ID NO: 288 - protein, 464 aa, M. haemolytica
MYKKHFLFLLVSPLVMAETVEFQQDPKEFDGQRQAVKFEQEIAKKDLKLTAYLEEDNSLKGIEQHINQAILRQDWAKLERLLGDYAKQEQFDPLLLDYALAALAYAKKDYRSAAFYYQQLLKKQPDLTYPRFDLALILKEDYRYREAEQEFKQLKTDDLRNAVNSALAQIEEEESWKPDFYLQYTQTNNVNNASSSPTVNVNGRIFIKESDSLPQSAKGVRYGVGLSKMRNIGGNHFVGVDLGYNGVYYWNNHDYSEQSVSLTPKYSYRTATYRIGVSPFIEQNWLGSSRYNYQFGSSINAVKLFERGLISGSFSHLQKRYSEQHIADRYNGYRNQLTLGTQWQAVKNWRFFANLNASREITREKAQSSNKWLATIGVIYQTPSWASSVSVGYGKRYFADKHYLFGYKRQDKEYQANVAVWNRSWHWQGIVPKLNFRYQKIDSNIADFYSRSNKEVFMTLEKLF

SEQ ID NO: 289 - DNA, 1410 bp, M. haemolytica
atgaaaaaatatccccttttattttcgctgttcagccccgttgtatgggcagaaaaggtgattgaacacaacactgacccgatttcctttgagcgtcagccgcaagcggttaaatttgagcaaaatgttgtaaaaaattcacaaaaaccgaccgcttatcagcctgcgtattcagtcaatcagaatgttgaacagcaaattaaccaagcgattctcagccaagattgggcaacgcttgaaccgcttttaagccgttatccgcaaactgaaaattttgacccgttgttgtggcactatgcgcaagccgcacttgcctatgcgaaaaaagatcatcaaaccgcagtttttcactatcgccaactgttagctaagcccccgagtttggtttaccctcgttttgatttggcgttgattttggcagaagatcagcaatttcgtgcggcagagcaggaatttaaggctattcaagcccatttaccgccggaacttgctaaaattgcccgcaatactcaagtccaaattgctgaaaatgaggcgtggcagcccgatttttatctgcaatatacccaaacagataacgtgaataatgcctcatcttcgccgattgtgaatgtaaatgggcggattttccgcaaaaatgcagacagtttgccacaatcagcaaaaggcgtgcgttatggcttagggttgagtaaattgcacaacgtgaaaggcaatcattttgtcggtttaacgctcaattatagcgggatttactattgggataaccgagattaccgtgagcaatccgtatccgtttcgccgaattatagctaccgcaccgtcgcttatcggctgactttttcgccttttattgagcaaaattggctggggagtagccgttataatgttcaatttggggcaacactcaacggtttgcgttaccttaattcgcaatggttggtgtcggggagttttacccatttgcaaaaacggtattttgaggagctaaccgcaagccgttataacagctatcagcaccaactcagtggcggtgtgcagtggcaagcggtcaaaaatgggcggttttttgcaaatttagacggcgtgcgtgaaattgcacgggaaaaagcacaaagctcgaataagtggctggctcgagtgggggcggtttttcaaggcgaacgctgggcaacgcaggcaagtatcggctttggcaagcgatattttgccgacaagcactatttgtttggctataagcggttagacacggaatatcaagccaatttagcggtttggaaccgcacttggcattggcagggcattgtgccgaagctgaatttccgttatcaaaaaattgacagcaatattgctgatttttactctcgccaaaacaaggaagtctttttcactttagaaaagctattttag

SEQ ID NO: 290 - protein, 469 aa, M. haemolytica
MKKYPLLFSLFSPVVWAEKVIEHNTDPISFERQPQAVKFEQNVVKNSQKPTAYQPAYSVNQNVEQQINQAILSQDWATLEPLLSRYPQTENFDPLLWHYAQAALAYAKKDHQTAVFHYRQLLAKPPSLVYPRFDLALILAEDQQFRAAEQEFKAIQAHLPPELAKIARNTQVQIAENEAWQPDFYLQYTQTDNVNNASSSPIVNVNGRIFRKNADSLPQSAKGVRYGLGLSKLHNVKGNHFVGLTLNYSGIYYWDNRDYREQSVSVSPNYSYRTVAYRLTFSPFIEQNWLGSSRYNVQFGATLNGLRYLNSQWLVSGSFTHLQKRYFEELTASRYNSYQHQLSGGVQWQAVKNGRFFANLDGVREIAREKAQSSNKWLARVGAVFQGERWATQASIGFGKRYFADKHYLFGYKRLDTEYQANLAVWNRTWHWQGIVPKLNFRYQKIDSNIADFYSRQNKEVFFTLEKLF

SEQ ID NO: 291 - DNA, 1413 bp, M. haemolytica
atgaaaaaaattgccttactggcacttttcccaatgatgttatttgcccgagatcctaatactacacaggcttatattgagcatactgcacagccaactacaaccccccaaagggtcaagatcgaaaaatcagtgcctatttttaacgaaactgaattacgtgctaatcaattattgaccgaaaagctacttatccaagctatttatagtcgtaggcttgctaacatggaaaaattaactgcgatttatcgggattttacccacattgacccggttttactgcgttatgcacaaggtaaaattgccctactgaaaggcgattacgcacaggcaattcagcacttccaaaccattcttgccaaacaacccaaactaaacactgtaagaattgagctggcgattgctctattgtacgatcagcaacttaatcaagcccaagcacaatttgaaaaagccaaaagtgccgaacatctaccgcctaaagttcacgcattaattgagcaatatcagcaacatctggcaaaaaaacaggaatggaaatttagtttttcagccaattatgtgcgagacggcaacattaaccgaacctcgaaacagccgaacattgagcaaaccggctatgtaaaacaacctaatttgttgccccaaaccgcacatggtgttcactatgcgtttggattacagagagatttcaacctgttcgactcacactatgtgagttttgacaaccaaacccaaggtgaactttattgggataaccacgattatgatgaaattaccaatcgcaccttgtttggatacgcttacaaaaaatccgaccaaaccacccgcttgttaccgttttatgaaaaacgctggaaacatcaccgttcggaacgctggacaaacggaattcgacttgaacacgcacaatggttttcaccgcattggcaactcgccaccgcattggaatacggcaaaaaacgttattttgatttgccgatttataacggcagctacaaacttgcctctgccacattgctttggttacgcaatccacaacaatttttctttgtcggcactgatttcaatcaagacaaaactcagttaaaacaatatagctctgatactaaaggcatacgctttggctggcaacgagaatggcaagccctcgagctttccagtcgcctcacgcttggctatactgacagacgttacaaagacaccgctatattgggaggaaaacttaatcttggcagaatccgccatgaccgtgtgcaaagtgctaacctcacgctttggaaacgagattggcactggctcggcctgatgccgaagctgcaatttagttacgccaaacaccgtagcaacctgccgagcctctatgcctacaccgataaaaacatcaatttaattattgaaagtcggttctag

SEQ ID NO: 292 - protein, 470 aa, M. haemolytica
MKKIALLALFPMMLFARDPNTTQAYIEHTAQPTTTPQRVKIEKSVPIFNETELRANQLLTEKLLIQAIYSRRLANMEKLTAIYRDFTHIDPVLLRYAQGKIALLKGDYAQAIQHFQTILAKQPKLNTVRIELAIALLYDQQLNQAQAQFEKAKSAEHLPPKVHALIEQYQQHLAKKQEWKFSFSANYVRDGNINRTSKQPNIEQTGYVKQPNLLPQTAHGVHYAFGLQRDFNLFDSHYVSFDNQTQGELYWDNHDYDEITNRTLFGYAYKKSDQTTRLLPFYEKRWKHHRSERWTNGIRLEHAQWFSPHWQLATALEYGKKRYFDLPIYNGSYKLASATLLWLRNPQQFFFVGTDFNQDKTQLKQYSSDTKGIRFGWQREWQALELSSRLTLGYTDRRYKDTAILGGKLNLGRIRHDRVQSANLTLWKRDWHWLGLMPKLQFSYAKHRSNLPSLYAYTDKNINLIIESRF

SEQ ID NO: 293 - DNA, 1455 bp, M. haemolytica
atgaaaaaaatagtctcaacgcttttaatccttacctcaaacctggcatttgcggaaaccacaccggctcaacttcaagaaaaaatggataaccagcgaatgcagaaaaacctacatacattagaaaagcctgaacctcaagccaaaccacaagcggttaatgcacaggctcaccggcaatcgatctctatttcaagccaacagctgcttcaacagcctgagttgctcaactcggcaatgctaactgcgttggtcactaaccacactgagaatgttcaattcttactgcctatttatcaacaattacccgccagtaaacaaaacagcgaagttgtacaatgggcggaggcagttaatgccaaagcaaaacaaaattattcagaggcaataaaaggctaccgtcagctactggcaaaataccctgaaaatcagccaatccgtatgcaattagcggttgcattgtttgaaaatcgggaaaatgaagccgcagaggctcaattttataagttacaagcggacaaattaccgcaagaaattgcaaatgcggtcaatagctatttggaggcgattggcaagcaagatcaatggagttttcaaggcggcttaacctatttgaatgacccgaatatcaacaatgctccaaatgcaggcacgacctatggcaactggactgcaccgaaaaaagaatccgcccaaggggtcggctttcactttgaggcggataaaaagtggtcttggggcaatggtttcttccacgagtttcgtttaaacggaaacggcaaatattactggaataacaaaaaatataacgaatattcgctcagagaaagcctcggcttgggttatcaaaatgcaaaacaaaaaatcaccttgttgccgttttttgagcagatgtggtatgccggtggctcaagccaaaccgaaagcaccaaacgctactccaacgcaggcggtgtgaatgcccgctggcaatattggattactccacagtggcaatctgcaatcagctacgaatatgcggaacagcgttacactcgccgccaacatttagacggcaattatcattttattgccccgagcctctatttttaccctaacagccggcaatattggtttgtgggggcgaattttaaccgcaccagcccccgtgatttagatgatagctttattcgccgaggtgtttctattggttggggacaagagtggaaaaacgggctttcaacccaattaagtgccagctacgcccgcaaacaataccgagccccaatgccgattttccaaattacacaacgtaacagtgaatatggtgtgcaagccagcatctggcacagagccttgcattttaagggtattacccctcgcttaacgtggcaatataacaaggtaaaaagcaatcatagcttctatagttatgacaaaaaccgtgtctatattgagttttcacatacgttctaa

SEQ ID NO: 294 - protein, 484 aa, M. haemolytica
MKKIVSTLLILTSNLAFAETTPAQLQEKMDNQRMQKNLHTLEKPEPQAKPQAVNAQAHRQSISISSQQLLQQPELLNSAMLTALVTNHTENVQFLLPIYQQLPASKQNSEVVQWAEAVNAKAKQNYSEAIKGYRQLLAKYPENQPIRMQLAVALFENRENEAAEAQFYKLQADKLPQEIANAVNSYLEAIGKQDQWSFQGGLTYLNDPNINNAPNAGTTYGNWTAPKKESAQGVGFHFEADKKWSWGNGFFHEFRLNGNGKYYWNNKKYNEYSLRESLGLGYQNAKQKITLLPFFEQMWYAGGSSQTESTKRYSNAGGVNARWQYWITPQWQSAISYEYAEQRYTRRQHLDGNYHFIAPSLYFYPNSRQYWFVGANFNRTSPRDLDDSFIRRGVSIGWGQEWKNGLSTQLSASYARKQYRAPMPIFQITQRNSEYGVQASIWHRALHFKGITPRLTWQYNKVKSNHSFYSYDKNRVYIEFSHTF

SEQ ID NO: 295 - DNA, 1323 bp, M. jannaschii
atggccggagccttaggtgtgaatcactttaaacgttatttatcgttcgtttctttttcccttctggtttcaacagcccaggctgatacgcagattgagcaactcacctctctggttaatcagggggatatggcggccgcctatgatttagcgcagcaacttcagcctgaatatgagggcgatcctgcgtttgatctgcaatatggcattgcggctatcgataacggcgatattggccaggggatgtttgcgctggagcgggtgctggtattacggccggatatgcatctggcgcggctggagttggcgcggggctatttcctgcagggcaatgatctgcgggcaaaagagcagtttaacgcggtgctggagaataacccaccacctaaggtggtcgaccagattcaggccttcctgaacctgatcgccagccgggctgagaagagtcgctggagcgccggcggctcgctgcaactggcctggggctatgacgacaatatcaatgccgcgccggaatcacagaccacggtggtgacactaagcgatacggcactggggcgtggcgaccagttcactacgatgaagctgaacggccatgctgaatatcaggcaaccaaggctcagagctggtttggtaatgccaccctggaatcgcgctggtacgccgatgaagatccgcaggacttccgcaacctgcgcggcttggttggcagtcgctggctggacggtcgcaatcgctaccagttggcgctgaacgcgcagaattatcagctggataataacgattaccgggacagctacggggttggtggccagtggacctatgccctgagtaaaaccgctatcgtgacgacgtcgctggattacagccagcttgattatgatacggcggactggaaggacagtgatctggtcagcctcggagtgaatggcgttatcgtcggtaacggccactggacgccggtgtattttgccggaggctttgccggccgagaaaaaccggatagcccgggcgtgctggcagatgccggtgtcgaccgactgttcttcggcggccacatcggggccaggatagagccttatgatggcctgcagctgaccactaccctggtggcccagcgcagtaactaccgcggcaccgactttatctacaatatccgccgcgatgacaactacctggcactggcgctggatgccagctggaagctgccgcacgactggcgttttatcagcggtatcagctacagccgcaatgactccaatatcgaactccatgattacgaccgcacccaggttcgcctcggtgtgcagtatcagttctga

SEQ ID NO: 296 - protein, 419 aa, M. jannaschii
MVSTAQADTQIEQLTSLVNQGDMAAAYDLAQQLQPEYEGDPAFDLQYGIAAIDNGDIGQGMFALERVLVLRPDMHLARLELARGYFLQGNDLRAKEQFNAVLENNPPPKVVDQIQAFLNLIASRAEKSRWSAGGSLQLAWGYDDNINAAPESQTTVVTLSDTALGRGDQFTTMKLNGHAEYQATKAQSWFGNATLESRWYADEDPQDFRNLRGLVGSRWLDGRNRYQLALNAQNYQLDNNDYRDSYGVGGQWTYALSKTAIVTTSLDYSQLDYDTADWKDSDLVSLGVNGVIVGNGHWTPVYFAGGFAGREKPDSPGVLADAGVDRLFFGGHIGARIEPYDGLQLTTTLVAQRSNYRGTDFIYNIRRDDNYLALALDASWKLPHDWRFISGISYSRNDSNIELHDYDRTQVRLGVQYQF

SEQ ID NO: 297 - DNA, 1386 bp, M. lonarensis
ttgaatcaaagtattgagctgcaatccagccagcaggaaaggcaaattctcaaggatgaagagtatctgcgagggcagcggcccaccctgaccattgacggtacgacccataccatcgaacacaacgtcaatgatgttggacgggcgttgtatttgtctattcaacagcggcaatggccagcggtgctgtattttctggatgaatatctgacattccctgatgcagatccgatgctgattgcctatgcacaaggttcgctggccagattacgaggcgagatgaagctggcggaaagcgagttcagaaaactgcttgatattcagcctgattttctgctcggacagctggagttggcgcgggtgttatttgaaaaccgtaaagatgccgattccgaagccatgtttcagcagattgccgtgactctggatcccgctgatgctcgtcatcagggcgtgttgacaacggtagacagttttttgcaggcggttgacagacgccaatcctggcagggctctgttgcgatgggtgcggtctggtcagataacctgaatcagacatccgagagttatacctgtctgctctattacggttcagtgtgtctgtttgaacgccagacgccagatgctatcaaagcgcatgggcttgattatgagatgaccttgaacaggcgctttgcattgtcggggcatcatggtgtgttttttcgcgggctgttgtttgggcaaagttataaagagcattctatttataacgaaagccaaatcagtacgcagttcggttacagctaccacaatatgcgtaaccagtattcgttggctcccacctttgagttttctcgttacggcaatgattcgctttatggtgcctggggtctgaatgcagagtggcagcactatttcagcgataaagtgatgttcaaactggagacaagttataaggatcagcagtaccggaaaagcgtacttgccgatcagtatgatggcgatatctggtctgcgtttgcgaccgcctggtatgtcttaccgaataactggacagtgtttggtggcctggactggacccggaaaaaagcccaaatcaaacaactcgcctacgaacagctgggggtcagagcgggtgtggccaaaacctttaatcagtacgtcaatgccgtgttgtttgcttcgtatcgtgagcgtgaacatgatgcgtttagcccattgtttggtgaacaacgcaaggatcgagaacaaaactataccttgattgtgcgcttccccggtcttgccatgtatggcatggaacccaatctgactttcaagcaccgcaaggtcgatagcaacattgactggctgtatgcctatgaacgcaacagtgtcagcctgaaactgcaaaaaaacttctga

SEQ ID NO: 298 - protein, 461 aa, M. lonarensis
MNQSIELQSSQQERQILKDEEYLRGQRPTLTIDGTTHTIEHNVNDVGRALYLSIQQRQWPAVLYFLDEYLTFPDADPMLIAYAQGSLARLRGEMKLAESEFRKLLDIQPDFLLGQLELARVLFENRKDADSEAMFQQIAVTLDPADARHQGVLTTVDSFLQAVDRRQSWQGSVAMGAVWSDNLNQTSESYTCLLYYGSVCLFERQTPDAIKAHGLDYEMTLNRRFALSGHHGVFFRGLLFGQSYKEHSIYNESQISTQFGYSYHNMRNQYSLAPTFEFSRYGNDSLYGAWGLNAEWQHYFSDKVMFKLETSYKDQQYRKSVLADQYDGDIWSAFATAWYVLPNNWTVFGGLDWTRKKAQIKQLAYEQLGVRAGVAKTFNQYVNAVLFASYREREHDAFSPLFGEQRKDREQNYTLIVRFPGLAMYGMEPNLTFKHRKVDSNIDWLYAYERNSVSLKLQKNF

SEQ ID NO: 299 - DNA, 1542 bp, M. macacae
atgaatggtttttttgcgataaaaacagcaacgcaattgacaacaaagctaacaacattgtgttgctgtttggcgtattttatgcctgtttttgccgatgataaagcggtgcagccgcccattttgcacccagaagcgggcattgatagtttgcaaaatgaacccattgcgactactttgccaattgacaattcaccacaaaccgagcaaattgcacccattgcaccaactgaaataaacgaaacgccaaccgtggatattgattttttaattaacaatcccaatgcatttgcgcatgttttttatcaagcggtaataaatgatgatgccgaaacgttgcgtttattagtgccgttttatcatcaattgccaagggattatcaagatgagattttattgttatttgcgcaaagtaaaattgctttaagcgataataatcataaattggctttgcaattattaaccgaattaagccaaaaacagcccaatttaactgcggtaaaaatgcaaattgcttcattgttattaaaaaataagcatgaccaaaaggcaactatcattttaaatgaattaaaaacctctgtgcattttaacaatttaacaacaacagaaaaaaaatggctaataaaacaaagtgcaattttaacacgcaaatataaaccgagcattgatattggtatgaacttgttatatttagataatattaattcagcttctaccaccgagcaaaaaaatattagcaaagaaaagccaaaaagcacgcacggtttggcgttgtctttggatttggataaatatacgccgcttaatcatggattgagtttatatactggtcttgatattgatggcaaattttaccgcgataacagtcataatgaagcgtctatttttgccaatattggcttgaaaaaaaataatacgcacggatttttgtctattacgccatttattgggcgcaattttgccaccgacaacaaacaaaaccttgtaccaagaaaaaacagtattggggcggcgtttaattggcaacataaatttaataatgaattaaataaaacgtggcaaaataatttatttatacgtgccgaacatggcaattatcaaaagtcgtatcaaggttataatggcaaccgttatcatttaagcgatactattgtattgcaaaataaccctaagcggcgttattctttggggataaattatcaattgagcgatttaacagatgccgccaaaagtagccatactgtgggagtaaatttaggtattttgcaacaatttaataatggcttttttgtgcaaggcaaattaagcgccgagcgtgagcgttatcatggcaaattattgcgccttgttaatccgaataatgtttatcgcaccgataaaaccataacgctgcaaacggctgtttggcataaaaatattaattggcagggtattacgccgcggcttagttatcgttatgtgaataataaaagtaatttgccagcgttatatagttataagaagcatagtgtgtttttggagtttgggcggtcgttttag

SEQ ID NO: 300 - protein, 513 aa, M. macacae
MNGFFAIKTATQLTTKLTTLCCCLAYFMPVFADDKAVQPPILHPEAGIDSLQNEPIATTLPIDNSPQTEQIAPIAPTEINETPTVDIDFLINNPNAFAHVFYQAVINDDAETLRLLVPFYHQLPRDYQDEILLLFAQSKIALSDNNHKLALQLLTELSQKQPNLTAVKMQIASLLLKNKHDQKATIILNELKTSVHFNNLTTTEKKWLIKQSAILTRKYKPSIDIGMNLLYLDNINSASTTEQKNISKEKPKSTHGLALSLDLDKYTPLNHGLSLYTGLDIDGKFYRDNSHNEASIFANIGLKKNNTHGFLSITPFIGRNFATDNKQNLVPRKNSIGAAFNWQHKFNNELNKTWQNNLFIRAEHGNYQKSYQGYNGNRYHLSDTIVLQNNPKRRYSLGINYQLSDLTDAAKSSHTVGVNLGILQQFNNGFFVQGKLSAERERYHGKLLRLVNPNNVYRTDKTITLQTAVWHKNINWQGITPRLSYRYVNNKSNLPALYSYKKHSVFLEFGRSF

SEQ ID NO: 301 - DNA, 1365 bp, M. mediterranea
atgaccaaccgcagacttgaaccgcgcgccggaaagccggcgcgcggcctgtgtctcgaactgaagcgcggaccacgcgcctttttgttcacgtttgcccttgtggccctcacgattggcgccccgcaatggggcttcgcaaaaaagtccaccgttaccggctttgacgcggtgcgtgtgctggttgaatatggccagtatgaaaatgcgatggcactggcgcaaagcttcgcgaccgacgaaaagggcaaggcgctcgctgccgccttcacgcaggccctcatactggagcagcagggccggttgccggaagcggcaagcgcgcttcgcgccatcctttcgcagaaccccgaggcccgcaacgtccggcgtgaacttgccagcgttctctacgaacagggcgagggcaacgcatcgctgcatcacttcgaacttctggccggcagcgccaatagtgccgatgagcgcgcgttctatgaacgccttgccgccaaggcccgcacgattcgtccctggtcgcttggtggctatctctcaatcgcccccagcaccaacattaccgaagcccccgatgccgacctcgtctatatcggcggcattcccatactgcctgccaaaaagaagagcggcatcggctatggctatgggttgaacggatcctaccgttttgaccttgatgaaatttcatcgatcacggtaggtggcggggtgaacggcaactggtatcgcgacaccagtttcaacacgagctactttgacagtttcgtcgactatcgccgggaaatgggggactggacggtgactggcggccttgtaggccagtatgtgatgaagggcgaagaaccttatcgctggtcgctcggaccggctttctcgctgcgtcacaatatgggacgaaagggcgtcacaacgctgcgtggcatgtggcgaaagctcgattaccacgaccgcgatgaactggacggcagcgaaaccgtgctggggatcagccatctctatgccatctcatcggcaagctcggtgcgtttcgggggcaatatcggctatgtcgatgcggcgaacgacaccaacagctatctccgcctttccctgaacgcgcagtatttccgggaatggagtttcggcgcgatttccgatatctcgattttcgcagatgatcgcaaatatcaggacataacctatctggccggcgaaaaacgctcagatcagcgtatccaggcctcgctcggcatcacgctgcgcaatctggcgatcaagggtttcgccccacgcatcgaatatgcctacacccagaacttctcgaatgtcgatgtctatgatttttcgaagaacacgctttcgacttatctgacgaagaggttctga

SEQ ID NO: 302 - protein, 454 aa, M. mediterranea
MTNRRLEPRAGKPARGLCLELKRGPRAFLFTFALVALTIGAPQWGFAKKSTVTGFDAVRVLVEYGQYENAMALAQSFATDEKGKALAAAFTQALILEQQGRLPEAASALRAILSQNPEARNVRRELASVLYEQGEGNASLHHFELLAGSANSADERAFYERLAAKARTIRPWSLGGYLSIAPSTNITEAPDADLVYIGGIPILPAKKKSGIGYGYGLNGSYRFDLDEISSITVGGGVNGNWYRDTSFNTSYFDSFVDYRREMGDWTVTGGLVGQYVMKGEEPYRWSLGPAFSLRHNMGRKGVTTLRGMWRKLDYHDRDELDGSETVLGISHLYAISSASSVRFGGNIGYVDAANDTNSYLRLSLNAQYFREWSFGAISDISIFADDRKYQDITYLAGEKRSDQRIQASLGITLRNLAIKGFAPRIEYAYTQNFSNVDVYDFSKNTLSTYLTKRF

SEQ ID NO: 303 - DNA, 1365 bp, M. mediterranea; identical to SEQ ID NO: 301

SEQ ID NO: 304 - protein, 454 aa, M. mediterranea; identical to SEQ ID NO: 302

SEQ ID NO: 305 - DNA, 1428 bp, M. morosus
gtggaaaggcacagattaatagcttcaagagatttgattttttgtcttatattaatacttttaaaaagtcatactgtctttgcggaacaatatgtcttgccaggacaagatcaaataaccgttaccgccgtccctttaacaacccaaccaaaagcgcaagagactctcaacgccaaactgcatgaggctatggccttgtattataacgggtcgtatcgtttggcattgcccatcctcaaagaagttgccgcccaaaacgatagtcgagaggtattgtattggttagggcggtctgcgtatgagacaggggaaacaggccttgctatcgaaaaataccaacaaatcctggcgcgcgagccgaaactttctagagttcgtttagaactggcggcagcttataaacaggcaggcaatactgatgcggcacaagcggaactgcaaaaagtgctggcagaaaatcccgatgcagaagttaaggagttaattgagaaagccgtggtggatatagaagaaccacaggtcgagtccaagcggttttttgcggctctccgggcttcaatggggccggaatacgacagcaatgttaacgtcgggcccagggatgagcgcattttattggcaaataaccaagcgctgacatctaaaaaccttgacggatggctgctcaaatttaacctcaacggcgacctgctctacgattttggcaagccaaatgggtttgtttggcataaccacattcaatttctccatcatgaatacccagacagcaccaatagtaactttaattacacccagacagatgtcaatacggggcttgattattatgaccgcaggtttaaggcgaaacttccgtttgggtttattgaccgacggttttccaataatgacctatcccatgcctattatttcatgccgaatattgaaattaacctacgcgacgatacggattttgccttatcgtaccgttatgaaaatgaagattttattgagcctcaatttgatgccttaagtggtataacgcatacaggcacgtttgggccacggtataaatttgaggcctttaatgcagagcattcactggcgttattcggcacctatagtcggcgtaatgcccacacagaccgtttttcctatgacgaatggtcaatggggccgtcgtacttcgcccggtttaaaacggggacagagttttacctggatttcaaatacttaaatcgcgattacgatgccccggcgttattgtttgtggataagggcaggcgtttggacaatcgctataccttaaccttttctctcagccagacattctacaaagtctacttcgtgtccttgggttatacctataccgacaatagctcgaatgcaaaattgttcgattacgacaaaaatatggtcgggctgaatgttggcacaaatttgaatttctaa

SEQ ID NO: 306 - protein, 475 aa, M. morosus
MERHRLIASRDLIFCLILILLKSHTVFAEQYVLPGQDQITVTAVPLTTQPKAQETLNAKLHEAMALYYNGSYRLALPILKEVAAQNDSREVLYWLGRSAYETGETGLAIEKYQQILAREPKLSRVRLELAAAYKQAGNTDAAQAELQKVLAENPDAEVKELIEKAVVDIEEPQVESKRFFAALRASMGPEYDSNVNVGPRDERILLANNQALTSKNLDGWLLKFNLNGDLLYDFGKPNGFVWHNHIQFLHHEYPDSTNSNFNYTQTDVNTGLDYYDRRFKAKLPFGFIDRRFSNNDLSHAYYFMPNIEINLRDDTDFALSYRYENEDFIEPQFDALSGITHTGTFGPRYKFEAFNAEHSLALFGTYSRRNAHTDRFSYDEWSMGPSYFARFKTGTEFYLDFKYLNRDYDAPALLFVDKGRRLDNRYTLTFSLSQTFYKVYFVSLGYTYTDNSSNAKLFDYDKNMVGLNVGTNLNF

SEQ ID NO: 307 - DNA, 1575 bp, M. nitratireducenticrescens
atggatgaaatatggccagatgcctttgggcatctggctttttctttttattaccaaagccgaattatgttgcctgaattacaactatcttttgtttcttcacggaaattggtgatctctactgcattgtttatcacactactgaccagcgtgaacagttgggcggacgataaggatacttctctgcggctgaatcaaagtattgatctgcaatcgaatgagcaagaacgacaaatcctcaaagatgaagattacctgaaaggggagcgtccgaccttaacgattgatggtaagacttacacaatcaaacacaatgtgaacgatgtaggccgtgcgttatatatgtcgattcaacagaaacaatggtctgcggtagggtattttttggatgaatatctgaccttttccaatgcggatccaatgttgattgcttatgctcagggagccctagccagacttcagggtaatatggaaaaggccgaagcagaatttaaaaccctgcttgatatcaaaccggattttatgctcggtcagttggaactggcccgagtattgtttgaaaatcgtaaagatgccgaatcggaggcgatgtttcagcaaatcgctcagtcgcttaatccggctgatgccaggcagcagggtgtgctcactaccgttgatagctttctgcaagcggttgataaacgtcaggcatggcaaggatctatcgcattaggcccaacctggtcggataatctaaaccagacatctgaaagttacagctgtctgttttattacggttcggtatgcctgtttgaacgtgctacccctgaagcggttaaatcccatggtatggattatgaaataacgttaaataaacgttttgctttgtccggtcatcatggtttgttttttcgttcgttatggtttgggcaaagttataaagatcattcgctctacaacgaaagtcagcttagcacccagttcggctacagctaccacaatatgcgtaatcagtattctttagcaccttcatttgagtttgttcgttatggtaatgattcactatacggggcttcgggtctgcatggtgaatggctgcattatctgagcgacaaagcgatgttcaagctggaagcagattataaaaatcagcaataccggaaagaacttattgccgaccagtacgacggtggtatctggtctacttatgcaacagcctggtatggcctgccaaataactggactgtatttggtggtctggactggacccgcaaaaccgccgaagtcgatcaaaatgcgtatgagcaaatcggcgtcagagcaggtgtcgccaaaacctttaatgcgcatattaatgcggtactgttcgcttcattacgggaacgtgaacatgatgcatttaatgcgttattggatgagcagcgtaaggatttcgaacaaaactataccgttattctgcgttttccgaccctcgctgtttacggcttggagcccaatctgacttttaagcaccgcaaagtgcacagcaatgtggactggctgtattcctatgaccgcaacagtgtcagcctgaaactggaaaaacgtttctaa

SEQ ID NO: 308 - protein, 524 aa, M. nitratireducenticrescens
MDEIWPDAFGHLAFSFYYQSRIMLPELQLSFVSSRKLVISTALFITLLTSVNSWADDKDTSLRLNQSIDLQSNEQERQILKDEDYLKGERPTLTIDGKTYTIKHNVNDVGRALYMSIQQKQWSAVGYFLDEYLTFSNADPMLIAYAQGALARLQGNMEKAEAEFKTLLDIKPDFMLGQLELARVLFENRKDAESEAMFQQIAQSLNPADARQQGVLTTVDSFLQAVDKRQAWQGSIALGPTWSDNLNQTSESYSCLFYYGSVCLFERATPEAVKSHGMDYEITLNKRFALSGHHGLFFRSLWFGQSYKDHSLYNESQLSTQFGYSYHNMRNQYSLAPSFEFVRYGNDSLYGASGLHGEWLHYLSDKAMFKLEADYKNQQYRKELIADQYDGGIWSTYATAWYGLPNNWTVFGGLDWTRKTAEVDQNAYEQIGVRAGVAKTFNAHINAVLFASLREREHDAFNALLDEQRKDFEQNYTVILRFPTLAVYGLEPNLTFKHRKVHSNVDWLYSYDRNSVSLKLEKRF

SEQ ID NO: 309 - DNA, 1326 bp, M. thermotolerans
atgcgcgcgcgcagaaacatttccttgatgttcagcctttttctgggcctgtctgtcccctgtcaagcccagtcgctggtacaggatgccgcggctcacatcgaagcagggcgttacgccgatgcctaccgcatgttgtcagccgaagagtcggaaagagccggagatcctcagttcgatctcttgctaggcatcgcggcgctcgaaaccggtcggcatacgctcgcggtattcgcgctcgagcgcgtgctcgcggtgcagcccgacaacgcgcgcgcgcgcgccgagatcggccgcgcctatatggcgctgggcgagtcggaaggtgcaaaacgtgaattgcaggcggtgcggggccaggacgtcccgcccgaggtggtacgcgccatcgatcgtctgctcgccgccatcgatcgtgcggccctgcaggggaggaccgcattcagcggttacgtagaggcggccgtggggcgcgataccaatgtaaacagcgcgacttcgctgacctcggtcaccgtgcccagtctgggcgcattcgtgctcgatacatccagccgcagtcgcagcgcctggttcagtgcgctgtccggcggcgtcaacgtgcgcgtgcctgtcaatcccgaatgggcgttgatcgccggcgcgtccggtgccggcagattcaatggcggcgaatcgcgtttcgacacgaccgcgctggacgggaatggcggcgttgtctggtcgcgggggcagcatcgggtaaccgccctgctgcaggccggcatgttcgaggttgatcaggaaaagttgcgcgattacacaggcggtctgctgcagtggcaatacactcacgatgcgcgcaaccagacgacggtctatgcgcagcagacgcggctgcgctacgaaggcagcaatgatgtgcgtgacgtaaaccgcaacatctatggcgtcgggcatgcaatgctgctgcccgacggacagacgctgctgttcgggagcgtctatctgggcgcggaaacaggccgcaacgatctgtcgtcgggcatcaatatcgcggccaatgatgtgatcggcttccgcttcggcgcacagcacagcctggatgagcgctggcagttgttcggtgcgctgtcgcacgaggcgcgtgattatcacgccaccgacccggtgttcggcgtcgtcagggacgacacgctgacatcgctgtcgctgggcgcaagttatgaattcgcgaagaactggctggcgacgccatcgctgtcgttctcgcgcaacgattcaagcatcagtctgaacgagtaccgtcgcggcattgcgcagttcgcggtgcggcgcacattctag

SEQ ID NO: 310 - protein, 441 aa, M. thermotolerans
MRARRNISLMFSLFLGLSVPCQAQSLVQDAAAHIEAGRYADAYRMLSAEESERAGDPQFDLLLGIAALETGRHTLAVFALERVLAVQPDNARARAEIGRAYMALGESEGAKRELQAVRGQDVPPEVVRAIDRLLAAIDRAALQGRTAFSGYVEAAVGRDTNVNSATSLTSVTVPSLGAFVLDTSSRSRSAWFSALSGGVNVRVPVNPEWALIAGASGAGRFNGGESRFDTTALDGNGGVVWSRGQHRVTALLQAGMFEVDQEKLRDYTGGLLQWQYTHDARNQTTVYAQQTRLRYEGSNDVRDVNRNIYGVGHAMLLPDGQTLLFGSVYLGAETGRNDLSSGINIAANDVIGFRFGAQHSLDERWQLFGALSHEARDYHATDPVFGVVRDDTLTSLSLGASYEFAKNWLATPSLSFSRNDSSISLNEYRRGIAQFAVRRTF

SEQ ID NO: 311 - DNA, 1452 bp, M. varigena
atgaaaaaaattattcctattgctttcagtttagctgcacattttgcattagctgataccgccccagctccaattcaagagaaaatggataatcagcggatgcaacaaaatcaatcgtttgagacaccggaacataaagttgctcaagctcagcccaaagtgcaaaatagcaatcagactatttcaatttcaagccaagaactcattcagcagcctgagttattaaattcagcaatgctgacggcattggtaacaggcaataccgaaaacgtcctctttttattgccgatataccaaaaactccctacatctaagcaaaatcgtgaaatgattacgtgggcaaaggcaacagaggcaaaatcaaatcaagattatactcaatctattaagctctaccgagagttgctggcaagttatccggaaaatcagccgatccgaatgcagcttgcggtggcactttttgaaaaccgtgaaaatgaagccgcagaagcacaatttcataaattacaagcggataaattacctataaaaattacaaatatcatcaatcattatttagaagccatcagtaaacaagacaaatgggtatttcaaggcggcttaacttatttaaatgatccaaatattaataatgctccagcttcaggcacaacttacggcagatggtcagctccgaaaaaagagtctgctcaagggattgggctaagttttgacgctgcgaaaaaatggtcttggggaaatggtttcttccacgagtttcgcctaaacggtaatggcaaatattattggaataataaaaaatataatgaatattcgcttagagaaagtttcggattaggctatcaaagtgcgaaacaaaaaatcacagttttacctttcttagagcaaacttggtatgcgggcggttctactcaaagtcaaagcactaagcgttattcaaatgcaggtggtgttaatactcgttggcaatactggattacgccacaatggcaatcctcaataacgtatgaatatgccgagcaacgttatacccgtcgccagcacttagatggaaattatcattttgtttctccgagtatttactaccatccaagcagccagcaatattggtttgttggagcgaactttaaccgcaatagcacccgagatttagatgacagctttattcgtcgaggtgtttcactaggttgggggcaagagtggaagaatgggctttcaagccaattaagcgtgagctatggtcgcaagcaatatagagcaccaatgcctattttccaaattacccagcgtaataaagaatacggcgtacaagcgagtatctggcacagagccgtgcattttaaaggcattactcctcgtttaacctggcaatataacaaagtaaaaagtaatcacactttttatagttatgataaaaaccgtgtgtatattgagttttcacatacgttctaa

SEQ ID NO: 312 - protein, 483 aa, M. varigena
MKKIIPIAFSLAAHFALADTAPAPIQEKMDNQRMQQNQSFETPEHKVAQAQPKVQNSNQTISISSQELIQQPELLNSAMLTALVTGNTENVLFLLPIYQKLPTSKQNREMITWAKATEAKSNQDYTQSIKLYRELLASYPENQPIRMQLAVALFENRENEAAEAQFHKLQADKLPIKITNIINHYLEAISKQDKWVFQGGLTYLNDPNINNAPASGTTYGRWSAPKKESAQGIGLSFDAAKKWSWGNGFFHEFRLNGNGKYYWNNKKYNEYSLRESFGLGYQSAKQKITVLPFLEQTWYAGGSTQSQSTKRYSNAGGVNTRWQYWITPQWQSSITYEYAEQRYTRRQHLDGNYHFVSPSIYYHPSSQQYWFVGANFNRNSTRDLDDSFIRRGVSLGWGQEWKNGLSSQLSVSYGRKQYRAPMPIFQITQRNKEYGVQASIWHRAVHFKGITPRLTWQYNKVKSNHTFYSYDKNRVYIEFSHTF

SEQ ID NO: 313 - DNA, 1410 bp, M. varigena
atgaaaaaatataccctcttatttccacttttcagtccttttgtgttggcagaaaccgtgattgagcacaacacagatcccgtttcttttgaacgccattcacaagcggtcaaatttgagcaaaattttgcaaaaaagccacaaaaaacgaccgcttatcagcccaaatattcgttaaatcagaatgttgaacagcaaattaaccaagcgattttgagccaaaattgggaaaacttagcaccgcttttaagtcgttatcagcaaatgcccaatgttgatccgttactttggcattacgcccaagcggcacttgcctatgcggaaaaagatcatcattcagccatttttcactaccgccaattactcgccagaaatcccaatttggtttatccacgttttgatttagcgttaattttggcagaagatcagcaatttcgtgaggcggagcgtgaatttagccatattcaagcctatttaccgcccgatttaggcaaaattgcggcgaatactcaaatgcaaattgcagaaaatgagcgttggcagcctgatttttacttgcaatatacccagacaaataacgtgaataatgcttcatcttcgccgattgtaagcgtaaatgggcggattttccgtaaaaatgaagaaagtcttccacaatcggcaaaaggtgttcgctatggtttcggattaagcaaattgcagaatttgcgtggcaaccattttgtggggttagggctgaattatagcggtatttattattgggataatcaagattaccgtgagcaatctctttctatttcgccaagttatagttaccgcaaggctcgctatcgctttagtttttcgccgtttattgagcagaattggttgggaagtagccgttataattaccaatttggagcaacggtaagtggttttcgttatctcaattcgcaatggttgatgtcaggtagttttacccatttacaaaaacgctattttgatgagctaaccgcaagtcgttataacagttatcagcaccaaatcagtactggactgcagtggcaagcggtcaaaaattggcgattttttgcaaatttagacggcagccgtgaaatcgctcgtgagaaagctcaaacgtcaaataagtggttagcaagagtcggggcagtttatcacggcgaaaaatgggcaactcaggcaagtttaggctttggaaaacgctattttgccgataagcactatttatttggctataaacggcaagataaggaatatcaagttaatcttgcggtttggaatcgtacttggcattggcaaggcattgtgccgaagttgaatttccgttatcaaaaaatggatagtaatattgccgatttttactctcgacaaaataaagaactgttttttacgttagagaagctattttag

SEQ ID NO: 314 - protein, 469 aa, M. varigena
MKKYTLLFPLFSPFVLAETVIEHNTDPVSFERHSQAVKFEQNFAKKPQKTTAYQPKYSLNQNVEQQINQAILSQNWENLAPLLSRYQQMPNVDPLLWHYAQAALAYAEKDHHSAIFHYRQLLARNPNLVYPRFDLALILAEDQQFREAEREFSHIQAYLPPDLGKIAANTQMQIAENERWQPDFYLQYTQTNNVNNASSSPIVSVNGRIFRKNEESLPQSAKGVRYGFGLSKLQNLRGNHFVGLGLNYSGIYYWDNQDYREQSLSISPSYSYRKARYRFSFSPFIEQNWLGSSRYNYQFGATVSGFRYLNSQWLMSGSFTHLQKRYFDELTASRYNSYQHQISTGLQWQAVKNWRFFANLDGSREIAREKAQTSNKWLARVGAVYHGEKWATQASLGFGKRYFADKHYLFGYKRQDKEYQVNLAVWNRTWHWQGIVPKLNFRYQKMDSNIADFYSRQNKELFFTLEKLF

SEQ ID NO: 315 - DNA, 1299 bp, M. varigena
atgcgattttgtatttcattgcttgcctttttcagtattcaaatggtattagcaaatcattccaaacttgaagaacagctaaaacaagcgatttaccaacaagaatttaaaaagatccaaattctactgaaagattataaacaacaagaaaatgcagatcctactgtaatcgcttatgcaaaagcgaagtctgcctttattcaacaagattaccaaacagcaatttctatttataggaatatcattagtcaaaagccggaattaaattcaatgcgtatggagcttgcggttgccttatttgcagataagcaagataacgaagctaagttgcaatttgataaagtaaagagtgttcctgatttgcccggagtagcttaccaaaaaattgaggcttatttagaggcgataaatcaacgtaatgaatggcaatttgacctgaatttttcttatcttaaaacggataatgtagcgaatgtatctcaccagccacagattgaaaatacgggttttattaaaaacgaaacgatgttaccacagaaagctaatggctttgcttttaatgtagatgtagcgaaagattttaatttatttaattctcactatttgagctttcgaaatgaagcaactggcaaaatttactgggataatcaccgttttgatgatgtatctaatcgccttctgctaggttatgcctataaaaaatcagataaaacactacgcattcagcctttttatgataaacgttggtttggtaataggtcttttcattggtctaatgggcttcaatttagttatgattttgctatctctaatcaatggaaaaatcagacggttttatcatttgaaaagcggtcgttttttgatgaaaatttgcaagccggtaatataaaagctttctccaatactttgctttggttgcctaatcctaaacaattattttatgttggggggacaatatcaaaagaaaatacgcgagaaaaacagtatggctcaacaagcaaaaatattcgcttaggctggttacaagaatatcaatggggaatttctagtcagttgagtttttcatttacccaccgaaaatttcacgatgaggcgatactcgtagggattattcctctcaataaaatcagacaagataaaatctatagtgtgaatgctaaattttggaaacgagattggtatttatggggcattacgcctaaactgaatattgtatggaaaaagcaacaaagtaatttagcaagcctctattcttatacagataagcaaattacagtattatttgaaaagagcttttaa

SEQ ID NO: 316 - protein, 432 aa, M. varigena
MRFCISLLAFFSIQMVLANHSKLEEQLKQAIYQQEFKKIQILLKDYKQQENADPTVIAYAKAKSAFIQQDYQTAISIYRNIISQKPELNSMRMELAVALFADKQDNEAKLQFDKVKSVPDLPGVAYQKIEAYLEAINQRNEWQFDLNFSYLKTDNVANVSHQPQIENTGFIKNETMLPQKANGFAFNVDVAKDFNLFNSHYLSFRNEATGKIYWDNHRFDDVSNRLLLGYAYKKSDKTLRIQPFYDKRWFGNRSFHWSNGLQFSYDFAISNQWKNQTVLSFEKRSFFDENLQAGNIKAFSNTLLWLPNPKQLFYVGGTISKENTREKQYGSTSKNIRLGWLQEYQWGISSQLSFSFTHRKFHDEAILVGIIPLNKIRQDKIYSVNAKFWKRDWYLWGITPKLNIVWKKQQSNLASLYSYTDKQITVLFEKSF

SEQ ID NO: 317 - DNA, 2115 bp, M. varigena
atgaataaaaaattactgctattactccttttctcaccattggtgaaagcggaaacaattgttgaatttgaccaagatcagaaagagtttaatcacgacagacaagcggttgaatttgaacaaaaaattgtaaaaaacacgcaaaaatcgaccgcttacttgcctgatgaacaagtaacagaaagtgtagaacaacaaattaaccaagcgatcttaacgcaaaattgggaaaagcttgaaatattactgacagcgtattcaatgcaacagcaagcagatccgcttctactggattatgcttcagcggcgttagcgtatgctaaaaaagatcatcgctcggcaattttttactatcaacaattgctcaagaaacaaccttcttttatttatcctcgatttgatttagccctaattctaaaagaagatttccgctaccgagaggctcagaaagaatttgagcaactgaaaacaactgctccacataatttacacgcgaccataaataatgcattggagcaaatggcggaagaggaacagtggaagcctgatttctatctgatggcactcggtttgcaaaatttccgactcaaaacattgtacaatctgcccacttataccgataacatccccaacattgccatgaaaaaacgtctgctcctcctcgccatcctgcccctttccctttacgccgccgatgtgccgcccaacgtaaaacccgagcttcaagtcaacactgccgaaccccaacagcccgaagcgcacaatatccctgccgaacagacaaacaggccgtctgaaaaaatcatcgacgtcgatgccgacaccctgcttgccaacaccgaattactggcacgcgccatgtattccgccgtcgtcgcccacaatatccccggcatcaaagccgttttgcccatttacgaacaatggcccgaacacgaccgtgccatggcacgctatgccaaaggtttgcttgcccaatccgaagggcgcgccgccgaagccgtcggccattaccgccgctttatcgccgagcagcccgatgcctccgccgtccgctggcagcttgcaaccgccttgtttgaagacaaacaaaacgaagccgcggccgaccagttcgacaaactgcaaaccgaatccctcccgcctgccttgcaagaacgcatcgaaacctaccgcaaagccctgcgcgaacgcgacttatggcaattcaacgccggcctgaacatcacgcgcgaacaaaacatcaaccaagcccccagccaacgccgtctgggcaaccacctgagcgacgaacaatgccgcgccgtgcgccttgtctatcccgacgacgactgcttccgaggctggacattccccgaacccatcgatgccaccgccgtccattaccaaatcggtgcagaaaaaaaatggtcgttgccacgtggcttctatgtcacggcaggcgcagaccattacggcaaaatctaccccaaacacaccaactacaacgacctcaccacacgcttctcggcaggcctaggctatgccgaccagcgcagcgatatcggcattaccccgttccacgaacgccgcttctacggcaacgacccctacacctacaccaacggcgcacgcctccactacaaccattggtggcaacccaagctacaaaccctcagcgcatttgaagcaggccgtctgaaaaacagccgccgcgaacattccgacaacaccagccaactgctcagcaactccatcgtgtactaccgcaacgcgcgccaatactgggtagccggtatcgacctctaccgcgaacgcaaccgcgacgacaaaagcgacagcttcaaccgctacgccctgcgcaccacatggggacaagaatggcccaaaggcctctccaccgtcctacgcctcagcgccgcccaacgccgttaccaagcccccggcttcttcagtaacgaacaaaaccgccgcgacaaagaaacctccgcctccctgagcgtatggcaccgcgccctccatttcaaaggcatcaccccgcgcctgaccattgcccacaacaaaacatggagcaacgacaagttctacgaatacggcaaaaccaaaatgtttgtcgaattgagcaaaacgttctga

SEQ ID NO: 318 - protein, 461 aa, M. varigena
MNKKLLLLLLFSPLVKAETIVEFDQDQKEFNHDRQAVEFEQKIVKNTQKSTAYLPDEQVTESVEQQINQAILTQNWEKLEILLTAYSMQQQADPLLLDYASAALAYAKKDHRSAIFYYQQLLKKQPSFIYPRFDLALILKEDFRYREAQKEFEQLKTTAPHNLHATINNALEQMAEEEQWKPDFYLMNNAASSPIVNINGRIFHKAEESLPQSAKGFRYGVGLSKMQNVSGNHFIGADLAYNGVYYWNNQDYSEQVLSITPSYSYRKATYRIGLSPFIEQNWLGSSRDNYQFGGRVNVMKLLERGIVSGSFSHTQKRYFDTATAEYYNSYRNQVTVGTQWQAVKNWRFFANVMANREIAREKAQSSNKWLATIGVIHQTQRWSSSASVGYGKRYFADKHYLLDYKRQDKEYQANVAVWNQNWHWNGIVPKLNFRYQKIDSNIADFYSRSNKEVFLTVEKVF

SEQ ID NO: 319 - DNA, 1494 bp, M. viscosa
atgaacctaatttccgcttcaaaacgatccattttagtatgcttattatttagcttttcttattattcagttgcagatcaagatactaaaatccagatccaacagcgggataatttaacggcaagtgagatagaacaagaattgcttgccgaagaaaatgaaaaagaaaaagaaaaaaaccaacaatcttcagccatgattattgatggtgaaacttatcaagtgaatgacacgttgccagaattggggcaagcgctgtatttttcggttcagtctcgtcaatggccgctcgcctcccaatatttagccaggtaccaaaagcttgacggcttcgacccattattagttcactataccaaaggtgcgctgtatcgtgttaaaggtgaacttacactagctgaacaggaatattctcaacttttagcactacaacccgactttttacctgcgcaattagaactggcacgcgtgcaatttgaaaatcaaaaaaacgctgacgcctattcactatttattctcatcaacgaaaacttaccttctaacaatacccgctctcaaggaatccgaaaaaccgtaacaagcttcattacggctgcaaaacacagagactcttggaacggatcatttagctttggaccgtcatataacgacaaccttaaccagtcatcacaatcctatacttgcttggctcggcttccgtcaggccaatgccgagtagaaagaagcacaccagaagctgtaaaagggacaggtgtcgattttaatgccagcctgaacaagcgtctctcattatctggtcatcatggtatcgcctttagcgggctggcttatggttccagctatttagataatgacaaattcaatgaacaaactttaatcaccagccttggatacagctatcaaaatgcaaataacaaattcaccttatcgccacagttggaatacagtgcttcaggtaataaagcactttacttcgctggaggtttgaaatttgactggtttaaaagcctggattcatcaagtgcgatgaagctagaaattgaggcggaatatcaagattaccgaccagtaaaccttgaatatcaatccgactggcagtggtcatcttacttaagcttatggcatcaattacccgacaattggctactatttggcggtttggattggacccaaaaagataacgatgaaaaggtgcatgcctatcaactcttcggcggaagattcggcgttaaccgagcatggggcgaactggttgatgtaaatctatttacttcctttaggcaacgtaaatatggtgagttcagcgcattattggacgaaagaagaacagatcaagaacaaagttatacactcatgctgtcctccaagtcgctctcattatacggtattacgccgctacttacgtggactcataagcgagtaaaaagcaacgttgactggctttatacctatcaacaaaacgaaatcgccttaaagttagaaaaaagattttga

SEQ ID NO: 320 - protein, 497 aa, M. viscosa
MNLISASKRSILVCLLFSFSYYSVADQDTKIQIQQRDNLTASEIEQELLAEENEKEKEKNQQSSAMIIDGETYQVNDTLPELGQALYFSVQSRQWPLASQYLARYQKLDGFDPLLVHYTKGALYRVKGELTLAEQEYSQLLALQPDFLPAQLELARVQFENQKNADAYSLFILINENLPSNNTRSQGIRKTVTSFITAAKHRDSWNGSFSFGPSYNDNLNQSSQSYTCLARLPSGQCRVERSTPEAVKGTGVDFNASLNKRLSLSGHHGIAFSGLAYGSSYLDNDKFNEQTLITSLGYSYQNANNKFTLSPQLEYSASGNKALYFAGGLKFDWFKSLDSSSAMKLEIEAEYQDYRPVNLEYQSDWQWSSYLSLWHQLPDNWLLFGGLDWTQKDNDEKVHAYQLFGGRFGVNRAWGELVDVNLFTSFRQRKYGEFSALLDERRTDQEQSYTLMLSSKSLSLYGITPLLTWTHKRVKSNVDWLYTYQQNEIALKLEKRF

SEQ ID NO: 321 - DNA, 1506 bp, Marinomonas sp. D104
atgcgtttttctaaaaacacactctgcagccttcttaattataagactttcggactagtcttattgtttatgttctcgcaacctgccacggcagacgatcatgatctagatactcaactaaggttaaaccaaagcatagaacaacaaagcaattcaaaggaaagtgagttactcaaagatgaagattacctaccaggaaaacgcccagagctgattctcaatagcaagtcttacaccgtaggacacaatgctaatgatatcgggcgtgcactctacgtttccatcaagcaaaaacaatggaatgccgttgtttattttctcaacgaatatcaaaccctccctgatgctgaccctcttttactcgcttatgcgaaaggcgcgctggctagaatacaaggtaatatggagcaagccacgatagaatatcgccacctcctcgacctgaactctgaatttttgccgggccaactggaactggctcgcgtcttatttgaagatcatcaagacaaagaagcggaggaaatgttcactcagatatccgccatacttgatccagacaacgcacaacaagctggcgtaaaccgcacagtagaaagtttccgtaaagcacttgaacagcgccgtgattggtcgacttccatcgcgcttggtgcagtatggaatgataaccttaaccaatcctcagaaagccgaacttgtctgctgatgtatcaaaatcaatgtgtttatgaacgtaaaatccctgacgccatgtcagcaacagggcttgattacgaacttaccatcaacaaatacatgccaattgtcggtcataatggactgtattctcgctctttgctgtacggtaaaagttatggtgattacagtgattacaatgaaagtacgttagtaacacagctaggttatcgctaccaagatattggtgaccagatacaactcgctccttcttttgaattttccgcctatggcaataaagcgatgtacagtgccttaggcctccatggcgaatggactcgccgcttttctaacaagcaaatgttcaaactccaaggcgattacaaagaactgcgctacaaaaagcaaaactatgaacgttataacggcccttcctactcagcaaacgcaaccatgtggcaagtcttgccaaacagctggacgttattcggaggtgtagatggattagataggcaagcagacgataaaccctatggttatatacaactcggcgtacggctgggggtctcaaaatcgttttctaatgttctaagcgcaacatttttcacctctttccgcgaacaaacttacaaagcgtacagcagcattcttggcgcaaaacgcaatgaccatgaaagcagttacacattgatcttgaaatcgcctcaactgtccatcttaggttttactccgagcctaaccatcaaacactcaaatataaacagcaatgtagattggctatatagccgtgaaaacaaccaagtcagcctaaaattagagaagactttttag

SEQ ID NO: 322 - protein, 501 aa, Marinomonas sp. D104
MRFSKNTLCSLLNYKTFGLVLLFMFSQPATADDHDLDTQLRLNQSIEQQSNSKESELLKDEDYLPGKRPELILNSKSYTVGHNANDIGRALYVSIKQKQWNAVVYFLNEYQTLPDADPLLLAYAKGALARIQGNMEQATIEYRHLLDLNSEFLPGQLELARVLFEDHQDKEAEEMFTQISAILDPDNAQQAGVNRTVESFRKALEQRRDWSTSIALGAVWNDNLNQSSESRTCLLMYQNQCVYERKIPDAMSATGLDYELTINKYMPIVGHNGLYSRSLLYGKSYGDYSDYNESTLVTQLGYRYQDIGDQIQLAPSFEFSAYGNKAMYSALGLHGEWTRRFSNKQMFKLQGDYKELRYKKQNYERYNGPSYSANATMWQVLPNSWTLFGGVDGLDRQADDKPYGYIQLGVRLGVSKSFSNVLSATFFTSFREQTYKAYSSILGAKRNDHESSYTLILKSPQLSILGFTPSLTIKHSNINSNVDWLYSRENNQVSLKLEKTF

SEQ ID NO: 323 - DNA, 1497 bp, Marinomonas sp. MWYL1
atgcattttttaaaaagtaactttcttcattgcaagatagtcggattggccttgctgtttatgttctcacggtctgcaacagcagatgatcacgatctagatactcagctcaggttaaaccaaaacatagaacaacaaaacaattcaaaggaaagtgagttactcaaagatgaagattacctatcaggaaaacgcccagagctgattcttgatggcaagtcttacaccgtaggacacaatgctagtgatattgggcgtgcgctctatgtttccattaaacaaaaacaatggaatgccgtcgtttactttctcgatgaataccgaacacttaccgatgctgatccacttttactcgcttatgcgaaaggcgcattagctcgaatccaaggtaatatggaacaagccgcaacagagtatcgccagctcctcggcctgaaccctgaattcttgccaggtcaactggaactggcccgcgtactattcgaagatcatcaagataaagaagcaaaggtagtttttacacaaatatcggcaaagctcgatcctgacaatgagcaacagaccggcgtctatcgtacggtagaaagtttccgtaaagcacttgaacaacgccgtgattggtcgacgtccatcgcgcttggtgcagtatggaatgataaccttaaccaatcttcagaaagtcgtacctgtttactcctttcccaaggccaatgtatttatgaacgaaaaatccccgatgctatttcagcaacggggcttgattacgaactgacccttaacaagcacacacctattacgagtcataatggactgtattttcgctctttgctatatggtaaaagctatgacgattacactgactacaatgaaagtacgctaattacacagctaggttatcgctaccaagatctcgatgaccagatacaactcgctccttcttttgaattttccgcctatggaaataaagccatgtacagtgccttaggcctgcatggcgaatggactcgtcgcttttctaacaagcaaatacttaaagtccaaggcgattacaaagaactgcgctataaaaagcaaaactacgaacgttataacggcccttcctactcagcaaatgcaactatgtggcaagtcttaccgaatagctggacgttatttggaggtgttgatggcttagaccgacaagcggatgataaaccctatggctacttacaacttggcgtacgactcggggtctcaaaatcgttttctaatgttctaagcacaacatttttcacctctttccgcgaacaaacctacaaagcgtacagcagcattcttggcgcaaagcgaaatgaccatgaaagtagttacacattgatcttgaaatcgcctcaactgtccatcttaggttttgctccgagcctaaccatcaaacactcaaatataaacagcaatgtagattggctttatagccgtgaaaacaaccaagtcagcctaaaaatggagaaaaatttctaa

SEQ ID NO: 324 - protein, 498 aa, Marinomonas sp. MWYL1
MHFLKSNFLHCKIVGLALLFMFSRSATADDHDLDTQLRLNQNIEQQNNSKESELLKDEDYLSGKRPELILDGKSYTVGHNASDIGRALYVSIKQKQWNAVVYFLDEYRTLTDADPLLLAYAKGALARIQGNMEQAATEYRQLLGLNPEFLPGQLELARVLFEDHQDKEAKVVFTQISAKLDPDNEQQTGVYRTVESFRKALEQRRDWSTSIALGAVWNDNLNQSSESRTCLLLSQGQCIYERKIPDAISATGLDYELTLNKHTPITSHNGLYFRSLLYGKSYDDYTDYNESTLITQLGYRYQDLDDQIQLAPSFEFSAYGNKAMYSALGLHGEWTRRFSNKQILKVQGDYKELRYKKQNYERYNGPSYSANATMWQVLPNSWTLFGGVDGLDRQADDKPYGYLQLGVRLGVSKSFSNVLSTTFFTSFREQTYKAYSSILGAKRNDHESSYTLILKSPQLSILGFAPSLTIKHSNINSNVDWLYSRENNQVSLKMEKNF

SEQ ID NO: 325 - DNA, 1317 bp, Martelella sp. AD-3
atgcggcattttctgtcattgatgcgtttgaggctgtcaggcggcctggcggggcttgcctttctgttgacggtcttcgccgccggcatggcctttgcggtcgtcaatccgtttccgcaaatcaaggtgctgatcgagagcggccagtatgagaaagcgatggcgctttcggcgcagctttccgacgaccctgagctttccgcgctgtcgcagcaattcacctatgcgcttatcctgaagcatgagggccacttcagggaagcggcgatcctgatgcgcggcgttctcgacaagaagccggatttcacccgcgtgcgccaggagcttgcccacacgctggcgctgatgggcgagaagaaggcggcgatctatcatttctcgcttctggccgacaacgcgccgagcgaatcgctccgctccttctacgaggacttcatcgaccgggtgaatatcgaccgcccctggacgcttggcggttacctcgccattgcgccaagcaccaatatctccaacgccacggatcagagccttgtccatgtcggcggcattccgcttgcgcccggcacgaaggcggaaagcggcgtggggctcaattacggcgtcaacggcacctattccttcgatctcgtcgacgacctgtcgctgaccttcggcggctccgtcaccggccttgcctacagggaaaaggcctataaccagacccagttcggcggcttctcgcagctttcctggcgcaacgacccgtggattttcagcggcggcatggcggcggaatatgtgctgatgggcaatgagccttaccgcgtcggctatggtccggtcttttccgtgcgacgctccttcgggcccttcggcgtcacgtcggccaatttctcgttccagtggctcgattatcacgacatggatgcctatgatggctaccaggccggcatgagcatcaaccatcgctatgcgctgacgccatcgagcagcatccgcatgggcggggggttcaactatgtctccgccgaaaaggacttcaattcctattccggctacaacatcaacgccaaatatgcccgcgaatggtcgggcgggatactgaccgacatagaggtcgagggcacgctgcgggactatgagggcgattttccgctgatgaccaagtcgcggcttgaccgcaggctcgacatagccgtcggcgccacctttcgcacgcttgcgatgaaaggcttcgcgccgcgcctcgaatatgcctattcgaagaatttctccaatgtcgaactttacgaatacgacaagagcacggtttcgctgttcgtcaccaaacagttctga

SEQ ID NO: 326 - protein, 438 aa, Martelella sp. AD-3
MRHFLSLMRLRLSGGLAGLAFLLTVFAAGMAFAVVNPFPQIKVLIESGQYEKAMALSAQLSDDPELSALSQQFTYALILKHEGHFREAAILMRGVLDKKPDFTRVRQELAHTLALMGEKKAAIYHFSLLADNAPSESLRSFYEDFIDRVNIDRPWTLGGYLAIAPSTNISNATDQSLVHVGGIPLAPGTKAESGVGLNYGVNGTYSFDLVDDLSLTFGGSVTGLAYREKAYNQTQFGGFSQLSWRNDPWIFSGGMAAEYVLMGNEPYRVGYGPVFSVRRSFGPFGVTSANFSFQWLDYHDMDAYDGYQAGMSINHRYALTPSSSIRMGGGFNYVSAEKDFNSYSGYNINAKYAREWSGGILTDIEVEGTLRDYEGDFPLMTKSRLDRRLDIAVGATFRTLAMKGFAPRLEYAYSKNFSNVELYEYDKSTVSLFVTKQF

SEQ ID NO: 327 - DNA, 1362 bp, Martelella sp. AD-3
atgaccgaccgcagatctgagccgcgcgcgcgagacccggcgcgcggcctggagcagcggctggagcgcacaaagcgcttcatgctcgcgttcgcccttggcttattcacgatgggcattccgcaagtgggcttcgcaaaacagtccagcgtgaccggttttgacgcggtgcgcgtgctggtcgaatacgggcgctacgaagatgcaatggcgctggcggaaagctttgccgccgacgaaaagggcaagacgcttgccgctgccttcacgcaggctctcattctggagcagcagggccggttgccggaagcggcaagcgctcttcgcgccattctttcgcaaaatccgaaagcccgcaacgtccggcgcgaacttgccggcgttctctacgaacagggcgagggcaacgcatcgctgcatcacttcgaacttctggccggaagcgccagcagtgccgaagagcgcaggttctacgaacgcctcgccgccagggcccgcacgatccgtccctggtcgcttggcggctatctctccatagcccccagcaccaacatcaccgaagcccccgacgccgatctcgtctatgtcggcggcattcccatactgcctgccaagaagaaaagcggcatcggctatggctatggggtggacggatcctaccgtttcgacctcgatgaaatctcatcgatcaccataggcggcggggtgaacgggaactggtatcgtgataccagcttcaacacgagctacttcgacagtttcgtcgattatcgccgcgaaatgggtgactggacggtgaccggcggtgtggtcggccagtatgtgatgaagggcgaagagccttatcgctggtcgctcggcccggctttctcgctgaggcacaatatgggccgaaagggcgttacaacgttgcgcggcctgtggcgcaagcttgattaccacgaccgcgatgcgctcgacggcagcgagaccgtgctgggaatcagccatctctacgccatctcgtccgcaagttcggtgcgtttcggcggcaatgtcagctttgttgacgccgcgaacgacaccaacagctatgtccggttctccctgaatgcgcaatatttccgggaatggagtttcggagcgatttccgatatctcgattttcgcggacgatcgccgatatcaggatataacctatctcgcgggcgaaaaacgctccgatcagcgtatccaggcctcgctgggcatcacgctgcgcaatctggcggtcaggggcttcgccccacgcctcgaatatgcctacacgcagaacttctcgaatatcgatgtctatgatttttcgaagaacacgatatcaacctatctgacgaagaaattctga

SEQ ID NO: 328 - protein, 453 aa, Martelella sp. AD-3
MTDRRSEPRARDPARGLEQRLERTKRFMLAFALGLFTMGIPQVGFAKQSSVTGFDAVRVLVEYGRYEDAMALAESFAADEKGKTLAAAFTQALILEQQGRLPEAASALRAILSQNPKARNVRRELAGVLYEQGEGNASLHHFELLAGSASSAEERRFYERLAARARTIRPWSLGGYLSIAPSTNITEAPDADLVYVGGIPILPAKKKSGIGYGYGVDGSYRFDLDEISSITIGGGVNGNWYRDTSFNTSYFDSFVDYRREMGDWTVTGGVVGQYVMKGEEPYRWSLGPAFSLRHNMGRKGVTTLRGLWRKLDYHDRDALDGSETVLGISHLYAISSASSVRFGGNVSFVDAANDTNSYVRFSLNAQYFREWSFGAISDISIFADDRRYQDITYLAGEKRSDQRIQASLGITLRNLAVRGFAPRLEYAYTQNFSNIDVYDFSKNTISTYLTKKF

SEQ ID NO: 329 - DNA, 1308 bp, N. aromaticivorans
atggctgtgcccgctgccgaaaggccgcaggctcctgccgtcgaagccggggacgcccgaaagtctgtccaactcacgcccgcccagctcttcctttttgccgatgccgcgcgcgatgccggcgattttgccgctgccgaatccgcctatcgcgcgctcgccgcgaacccggatatcgacctgcgcaccgaagcgcgcttccgcctcggcctgatgctggccgatggcatgggtcgcccgcgcgacgctgccatcgaatttcgccgcatcctcgatgaaaagcccgatgccgcgcgcgtccggctcgaacttgcccgcatggacgccatgcttggccgcctcggcgcggcagagcgcgaatttcgcgccgcgcaggccactggccagctccccccggatgtagagcgcgcggtgcgcttctatgcttctgctttggctgccgccaagccgttcggcggcagcatcgaacttgccctcgcgcccgacagcaacatcaaccgcgctacccgttcggatacgctcggcaccgtcatcggcgatttcacgctcagcgacgatgccaaggcgaaatccggcatcggccttgcggcgcgcgcgcaggcctatgcccggcttccgctcggccagaaggcccggcttctcgcgcgtgtttccggcagcggcgatttctaccgcacccgcgcattcgacgattatgccctcgcgctccaggccgggccggaattcgtctcgggcgcggatcgcttcaccctttcggccggtccctcatggcgctggtacggccgcgtgccgttcacgcgcgggtggggcggctcggcggcatttcagcaccctctcggcaagcgcacgcagcttcgcacggaagccgcgctgtcgcggctcgacaacctgcgcaacgatccccaggacgccaccgtctacgccggaacgatcggcctcgaccgcgcctttgccgccaatttcggcggaggcctgcaactgcgcgccagccgcaccgccgcgcgcgagcccggctggtccgactggaccggcggcacctccgcctatctcttccgcgagatcggacgcaccacgctggtcctcgatgccagctatgcccgtcttgtcgccgacgaccggctgctgctctacccgcgaaagcgcgtggacgaccgctacggcgtcggcttcggcgcgaccttccgcagcatccagtggaagggcctggcgcccttcgtccgcgcccggttcgaacgcaacctgtccaccgtcgaactttacgatttcaaccgccgtgcagccgaactgggggtcacgtcggcattctga

SEQ ID NO: 330 - protein, 435 aa, N. aromaticivorans
MAVPAAERPQAPAVEAGDARKSVQLTPAQLFLFADAARDAGDFAAAESAYRALAANPDIDLRTEARFRLGLMLADGMGRPRDAAIEFRRILDEKPDAARVRLELARMDAMLGRLGAAEREFRAAQATGQLPPDVERAVRFYASALAAAKPFGGSIELALAPDSNINRATRSDTLGTVIGDFTLSDDAKAKSGIGLAARAQAYARLPLGQKARLLARVSGSGDFYRTRAFDDYALALQAGPEFVSGADRFTLSAGPSWRWYGRVPFTRGWGGSAAFQHPLGKRTQLRTEAALSRLDNLRNDPQDATVYAGTIGLDRAFAANFGGGLQLRASRTAAREPGWSDWTGGTSAYLFREIGRTTLVLDASYARLVADDRLLLYPRKRVDDRYGVGFGATFRSIQWKGLAPFVRARFERNLSTVELYDFNRRAAELGVTSAF

SEQ ID NO: 331 - DNA, 1422 bp, N. bacilliformis
atgccccgcccccacatcctcgccgccctcatcctcaccaccgccgcccaagccgcgcccgacccccgccccgaacccgaaccccgcttcgacctcaccgcccccaccgccatccccgcccccgaacccacagccaaccgcctcacccccaaccctaccggccaaaccctcaccatagacaaccccgatcaactcctgcaacagcccgaactcctccaccgcgccctctcctccgccgccatcgccggcaacgcccaagccgtcaaactcctcctgcccgtctaccgccgtctgcccgaacccaaagaccacaccctcctcgacctcgccgaaggtatcgccgcccacgccgacggccactacacccgcgccgtcaaacacctgcaacgcgcccaccaaaccatgccccaagccgtcatcatccgcctgcgcctcgcccaagccctcaaagacgaccaccgcgacctcgccgccgagagccactaccaaaccctcctcgacaccgacctccctcccgaagcccgcaccgccctgcaaagccaactcgacgaaattcgcagccgcagccgctggcagaccgaactcaacgccaactacacccgcgacaacaacatcaacaacgccccaagccaacgcaccgtccgctacgccggtggcacctggatcctgcccgaaccccaaaaagcccaaggcatcgcctacaatgccggccttgcccgtgacatcaacctccccggccactggcgcatccgcagcgaaaccgacgcctacggtaaaacctactgggacaaccacccctacgacgaccacaccgtccgcaccgccctcggcatcgcctacaaaagcggccgcagcgaagccgccctcctgccttatcaccaacaccgctggtacggcggcgcgacctacgcccgcgaaaacggcctccgcgcccaatggcagcggcagctttccgaacgccaccgcctcatcaccgccgccgaaaccggccgcccccgccacccacaccgcccctccgccgacggccgcgacagcagcctctccgccacctgggtctacctgcaaagcccccgccaatacctcaccctcggcgcagacctcgcccgcaaacgcgcccgcgaccccgacgaagcctaccgccgcaaagccctccgcgcctccatcgtgcgcatctggggcaaaggcctcggcaccgccctcaccgccgcctacgcccgccgcaaatacgacggcgcattcatcgtccccaccctccgcagcgaccgcgaatacaccgccaccgccgccatctggcacaaccgcctcagcttccggggcatcaccccccgcctcgtaaccgtctggcacaaaaccgacagcaacatccccttctacacctaccgcaaagccaacgccttcatccaactgggcaaaaccttctga

SEQ ID NO: 332 - protein, 473 aa, N. bacilliformis
MPRPHILAALILTTAAQAAPDPRPEPEPRFDLTAPTAIPAPEPTANRLTPNPTGQTLTIDNPDQLLQQPELLHRALSSAAIAGNAQAVKLLLPVYRRLPEPKDHTLLDLAEGIAAHADGHYTRAVKHLQRAHQTMPQAVIIRLRLAQALKDDHRDLAAESHYQTLLDTDLPPEARTALQSQLDEIRSRSRWQTELNANYTRDNNINNAPSQRTVRYAGGTWILPEPQKAQGIAYNAGLARDINLPGHWRIRSETDAYGKTYWDNHPYDDHTVRTALGIAYKSGRSEAALLPYHQHRWYGGATYARENGLRAQWQRQLSERHRLITAAETGRPRHPHRPSADGRDSSLSATWVYLQSPRQYLTLGADLARKRARDPDEAYRRKALRASIVRIWGKGLGTALTAAYARRKYDGAFIVPTLRSDREYTATAAIWHNRLSFRGITPRLVTVWHKTDSNIPFYTYRKANAFIQLGKTF

SEQ ID NO: 333 - DNA, 1416 bp, N. bacilliformis
atgcgctatcccatcctgatactctgcgccgccgcctgcgcggctgccgccgatcccctttccacgccgcacgacgacaaccccgaccccaaccgtagccaaatccgccaaatgcagcacgaagcccgtctgcccgcgtccgaacatgaaggagacgacggctctgtttccatgagcgaagacgagctgatcgcgcagcccgatttgctgcaaaacgtcctcgacaccgccgtggcgcggcagcaggttgaaaacatccgcttcctgctgccgctttaccgccgtttggacgaagaacggcgcgacgcggtgctggaagactacgccgaatccttcctgctgcgcgaagacgggcaatatgcccgcgccgaagaaaagctgcgcggcatccttgcgcaaaacccgggctacgcccccgtacgcctgcaactcgcgctcaccctgtcgcaaagcggccaaacgcgcgaagccgccgccgaagtggcggaagtgaaggaaacctccgaactgccgcccgatgcggccgcctttctcaacagcttttccgactacctcaaacgcgaccgcgcctggcagtttgacgccaacgcctactacctcgccgatcgcaatgtcggccgcgcgccgaaagagcgcgaatacggcccctggcgtttccccgaaccccgcgccgcgcacgggctgggctacgatgcctccgccgtcaaaaccctgcccgtaaaaaaacactgggcggcgcgggtgcaggcttccgtttacggcaaattctattgggacgcgcacgattacgacgatttgaacgcccgcatcgaagccgggccggtgtaccgcagcggcagcggcgaaaccgccctgacgccctttgccgaaaaacgctggtacggcacggaagcctattcgcacaccgcaggcggcgtgctgcgccgctcgcacaatctgtcgccgaaaaccatgctgtttgcaagctggcagacgggctataaaaagcatgaagaacgcgactatctcgacggcgcaagccacggcggcgcactctcgctggtgtaccaaagctcgccgcagcagtatttcgtgttcggcgcgggcgcggggcgcgaaaacgcccgcgaccctgcggaagcctaccgccacgcaagcctgcgcgcaggctggacgcgccgctggtcaggcggcgacggcctgcttacttcgcttaacggcagcatccgccgcagcctttaccgcagcgaggattttttcaacatccgccgccgcgacacggaatatttcgtcctcgccgccgtcggccacaaaaaactgtcgtggaaaagcttcaccccgcacctgaactggacatggtcgtatctggcaagcaaccatttctactaccgccgccacgaaaaccgcgtgtttttggacgtgtccaaacagttctga

SEQ ID NO: 334 - protein, 471 aa, N. bacilliformis
MRYPILILCAAACAAAADPLSTPHDDNPDPNRSQIRQMQHEARLPASEHEGDDGSVSMSEDELIAQPDLLQNVLDTAVARQQVENIRFLLPLYRRLDEERRDAVLEDYAESFLLREDGQYARAEEKLRGILAQNPGYAPVRLQLALTLSQSGQTREAAAEVAEVKETSELPPDAAAFLNSFSDYLKRDRAWQFDANAYYLADRNVGRAPKEREYGPWRFPEPRAAHGLGYDASAVKTLPVKKHWAARVQASVYGKFYWDAHDYDDLNARIEAGPVYRSGSGETALTPFAEKRWYGTEAYSHTAGGVLRRSHNLSPKTMLFASWQTGYKKHEERDYLDGASHGGALSLVYQSSPQQYFVFGAGAGRENARDPAEAYRHASLRAGWTRRWSGGDGLLTSLNGSIRRSLYRSEDFFNIRRRDTEYFVLAAVGHKKLSWKSFTPHLNWTWSYLASNHFYYRRHENRVFLDVSKQF

SEQ ID NO: 335 - DNA, 1482 bp, N. bacilliformis
atgaaaaaatatgccctgctgcccgccctgctcttgtctgccgccgcctttgccgacgacgacgacacccgcctgctgctcgacaacgcgcgtttccaaatgcgccagcagcaggccgaagccttttcagagtgcgaagcctcccgccctcgggactgcctctccgacagcggcagcatcgaaatcgacggcgaaacctatctcgtgccgaacaccgccaacgatttgaaactgggcatttactacgcaatcgacggcaggcagtggggcaaagtgcgcgaattcctccaacgctaccgcaacttgtccgaccacaagccgcaactggtcttgatggccgaaggcttgctggcgcgctcggagggcaaaaccgccgccgcgctggaaaaaatgcaggccgcacatgaaaccgcacccgaggatgtgcggatcaacttggaactggcgcggctctacggcgaggacaaccaaacccgcgaatcgcaggcgcagtttgaacaagtcgtaaaaacagacatcccgcccgaaacccgcgaaatggtgcagggctatcttgccgcgctcgaccgccgccgccgctggcacggcagcctcagcatcggcggcggctacaacgacaacatcaaccagggcaatggcaagcgcgaatgcgtcggcatgtttatggggcagtgtttcagctaccgcagcctgcccgagccggtcggctcggcgttttggcagtacagcgcggttgccgccaaaaaaatccccctgcgcggccaccacaacctgctgctgcgcggcctctcctacggcaccaaataccgccgcgacgacacccagtccgaaccgcccgagccgtacagcgaaaacaccgccgcgctgtatgcgggctacgaatacaccgatgcccgcaacgatttcacccttaccccctatttcgagcactactatcgcggcagccgcagccgttaccgcgcatggggcgcggaagcgggctgggagcgcaatctcaacgccaaatggtcgctcaacgcccgcgccgaaggccgccgcgtcaaatacctcgaacaggagcggcagtattacagcgactacacgctttacaccggcggcgtggggctgggctacaccttttcagacggcctcggcctttacggcggcatcgacctcacccgccgcaaatatccctacgccgcgtccagcagcaaggaatacaccgcccgaatcggcggctacaaaatgttccaaaacggcatctatttcaacgccgccgccctctaccgcaaaagccgctacgacgcgggcagttacctcaccgcaggcgagccgcgccgcgaccgccaaaccatcttcaccgccgccctcggcgcatcgaaactctcgtttaaaaacatctaccccgagctgcgcttcaaacgcacccttgcccgcagcaattccgatttctacgcctaccgccaaaacgaatacgccctggctttgaaataccgtttttaa

SEQ ID NO: 336 - protein, 493 aa, N. bacilliformis
MKKYALLPALLLSAAAFADDDDTRLLLDNARFQMRQQQAEAFSECEASRPRDCLSDSGSIEIDGETYLVPNTANDLKLGIYYAIDGRQWGKVREFLQRYRNLSDHKPQLVLMAEGLLARSEGKTAAALEKMQAAHETAPEDVRINLELARLYGEDNQTRESQAQFEQVVKTDIPPETREMVQGYLAALDRRRRWHGSLSIGGGYNDNINQGNGKRECVGMFMGQCFSYRSLPEPVGSAFWQYSAVAAKKIPLRGHHNLLLRGLSYGTKYRRDDTQSEPPEPYSENTAALYAGYEYTDARNDFTLTPYFEHYYRGSRSRYRAWGAEAGWERNLNAKWSLNARAEGRRVKYLEQERQYYSDYTLYTGGVGLGYTFSDGLGLYGGIDLTRRKYPYAASSSKEYTARIGGYKMFQNGIYFNAAALYRKSRYDAGSYLTAGEPRRDRQTIFTAALGASKLSFKNIYPELRFKRTLARSNSDFYAYRQNEYALALKYRF

SEQ ID NO: 337 - DNA, 1260 bp, N. bacilliformis
atgccgtgcctgctgcctttgacggtgatttgttcgagattggccgattctctgatttttgcgggtgtatcgtcggcgtgggcggaggcggcgcggctgctggcggcctaccgcgcaacggacggccacgatgaaaatctggccgcgttcaccgaggcgagcatcgcgcgtttgaacggcgattatgcgggggcgttgcgccaatatgccgatctgctggcgcggcagccggattttgcacgggcgcggctggactatgcgaaaacgctgttcgacgacaaacagacgcgcgaggcgcaggcgcagtttgcccggttgcagcaggaagagttgcccgagcctgtgcagcagaacatcgcggcctatctcaacgcggccaaagtgcgcggggcgtggcacggctcgcttgccgtcggcggcgtgcgcaacagcaatgtgcgcgaaaccaccggcgaaacctactgttttgacccctacggcctcacctgcgcgctcaccgccgcgcccgaagcggccgaaggattcacctacgaagcctcggcggaaaaacaccgtgctctggccggacatcacggcctgttcgcccgcgccacgctttacggcacgcgttacaagcatttccccgacagcagcgaagacacgctgaacgtgtcggcgggctaccgctactcgtcggccaaaaacacctggtcggccgcgcccgtggccgagtggggcagggcggacagcagcctgctctaccgcagcgcggggctgcgcggcgaatggcagcacgatttttccgagcgtaccgccctgagcgcggaggccgaataccgcgaaatgcgctacgccgaagactacgcgggcaacgacggccgcctgttttcactctacgccacgctgatgcacgccccgtccgatgcctggatgctctacggcggcgcgaacgtgcaaaagcgcaaaacgcagagcgaggccaccggctatctgacgcacggcttccaagcgggggcgcaataccggcgcggcgacgcgttttccctgcgcccgcacgccgcgctgcgctaccgccgctacggcggtttcaacccgtggatacaggtgcgccgcagcgacagcgagcaaagctactcggccacgctgaaaattccgcgctggaaaatcgccggcttcacccccgttttccacgtccgccacacgcgcgtgcacagcaacgctggctggctggccggctggcgcaaaaacgaagcggggatacgcttggagcggtttttctga

SEQ ID NO: 338 - protein, 419 aa, N. bacilliformis
MPCLLPLTVICSRLADSLIFAGVSSAWAEAARLLAAYRATDGHDENLAAFTEASIARLNGDYAGALRQYADLLARQPDFARARLDYAKTLFDDKQTREAQAQFARLQQEELPEPVQQNIAAYLNAAKVRGAWHGSLAVGGVRNSNVRETTGETYCFDPYGLTCALTAAPEAAEGFTYEASAEKHRALAGHHGLFARATLYGTRYKHFPDSSEDTLNVSAGYRYSSAKNTWSAAPVAEWGRADSSLLYRSAGLRGEWQHDFSERTALSAEAEYREMRYAEDYAGNDGRLFSLYATLMHAPSDAWMLYGGANVQKRKTQSEATGYLTHGFQAGAQYRRGDAFSLRPHAALRYRRYGGFNPWIQVRRSDSEQSYSATLKIPRWKIAGFTPVFHVRHTRVHSNAGWLAGWRKNEAGIRLERFF

SEQ ID NO: 339 - DNA, 1524 bp, N. bacilliformis
atgttcccgaaaaaaaccgtcccgctgctccccttgctgtttttcaccctctcctccgcgcccgcccttgccgacgacccctccgccaaaatccaaaccacccccgaatccggcctgctgcgcggccttgccgacgatttggaaagccgccgcgaacagatcgaaaccaacagcggcctgcgcaaaaaaaaaaacgccgccgcgcaggaggaaagcgaagacatccccgatttggacgacgaagatttgaaaaaacatcccgagctggccaaccgcgtgttaaacgccgccatgctctccgaagactgggacacactggaacacgtttccggcttctaccacgacatccccggccacgaccccgtgctggacgcctatgtgcgcggcgcgcttttgcgcgcgcagggcaggccgggcaaggccgcgaaggtgtaccgcgacatcttgcgtcaacatcccgatttgagctatgtccgcctcgatttggcgggcatgctgtttgaaaaccgcgcctacaaagacgcgaccaaagagtttgaacaggccaaacgcgaagacatcgaacccgaagcggcggcgcaggccgacgcctatctggcggcggtgaaacaggccgacccatggcagatcaggctgcgcggcggctggcaatacggcaacaacaccaacaacgccacctccaacgactacttcctctggccgtttgccgtagtcggcagcataacctactactacaaactgccgcgcgaccccgaaagcctgccacagcggcagcggcatcagctacggcgcgcaaatcggcaaagacaccaacctcgcaggcaaccacaacatcggtttcaacctcgaagccgaaggcgtgcgctacccgcactagcgcgacgacgacgaattttccctctccctagacgcaggctacaaataccgcacgctcaacaacaccttcgccctcacaccccgctcgtttccgcctcatggctcggcggccgccaatacagccgcaacaccggcgcaaacgcctcgttttcccgctgggcaaccccccgcctgcaactctccggcgcgtacaccttcatccgcaaaaaataccgcgacgaacgctacgccggctacaacgccgcgctcaacggcctctccgcctccgccgtctacgcgccctcaccccaaactggttcgccttcggcggcctcggcgtgcagcgcgaaaaaaccgacgataaagaagaaacctccacccgccgcttcgccaacctcggcacactctaccgtttcgccaacggcaccaacatccgcatcggcggccgctacgtctcccgcaaattcgcccgccccgccgccctctacggcggcatcacccgcagcgactgcgaaacctacgccgacgcttcggtgtggaaagaaaaatggctgcccggcggcatcaccccctaagctggaattctcctacctcaaagtcagaagcaacatctacgccttcccgcgcaacaaaaaacagatctccttcacgctggaaaaagagttttga

SEQ ID NO: 340 - protein, 507 aa, N. bacilliformis
MFPKKTVPLLPLLFFTLSSAPALADDPSAKIQTTPESGLLRGLADDLESRREQIETNSGLRKKKNAAAQEESEDIPDLDDEDLKKHPELANRVLNAAMLSEDWDTLEHVSGFYHDIPGHDPVLDAYVRGALLRAQGRPGKAAKVYRDILRQHPDLSYVRLDLAGMLFENRAYKDATKEFEQAKREDIEPEAAAQADAYLAAVKQADPWQIRLRGGWQYGNNTNNATSNDYFLWPFAVVGSITYYYKLPRDPESLPQRQRHQLRRANRQRHQPRRQPQHRFQPRSRRRALPALARRRRIFPLPRRRLQIPHAQQHLRPHTPLVSASWLGGRQYSRNTGANASFSRWATPRLQLSGAYTFIRKKYRDERYAGYNAALNGLSASAVYAPSPQTGSPSAASACSAKKPTIKKKPPPAASPTSAHSTVSPTAPTSASAAATSPANSPAPPPSTAASPAATAKPTPTLRCGKKNGCPAASPPKLEFSYLKVRSNIYAFPRNKKQISFTLEKEF

SEQ ID NO: 341 - DNA, 1434 bp, N. cinerea
atgactgcacaaaacagatgggtattgctactgtctttgttggcaacagcggcatacgccgaagaaataccgcacggacctgatttgagaaacaagcccgagttcaagatccatgaagtggaagttaaacccgtcaacagggaaaagatatcggaacaggtacaggaaaaagggaaagttttgcagattgacggagaaaccctgctgaaaaatcccgaattactgtcccgagccatgtattccgcagtggtttcaaacaatattgccggtatccgagttattttgccgatttacctaaaacaggcgcagcaggataagatgctggcactttatgcacaagggattctggcgcaggcagacggcagggtgaaagaagcggtttcctattaccgccggctgattgccgtccagcccgatgcgcctgccgtccgtctgcgccttgccgccgcattgtttgaagacaaacaaaacgaggcggcggcagaccagttcgaccgtctgaaaacagaagacctgccgcctcagcttatggaacaagtcgaattgtaccgcaaggcattgcgtgatcgggatgcgtggaaattcaacggcggattcagcgttacccaagagcggaatatcaaccaggccccgaaacagcaggaatatggacaatttacgctaccgaaacaggtgaacggtacggcagtcaactatcagatcggcgcggagaaaaaatggtcgttgaaagacggatggtatgcgacggcgggcggcgatttgttcggcaggatttatccggacaacacgagatttaacgacatgacggcgcgcgtatctaccggtgcaggctattcggatcagcgtaaagatatagggctgacggtattccacgaacgccggacctacggcaacgatgcctattcttatgccaacggcgcgagggtaagtttcgactattggctggcgcagaaactgcagatgcttaccgccgtggaaacaggttatctgaaaaatatacggtatgaccgttccaacaacaaaaaccttatgttgagccattccttgatttactatcccaatgcgcggcaatattggatgggcggtttggatctttaccgcgagcgcaaccccgccgaccggggcgacaatttcaaccgttacggcatgcgttttgcttgggggcaggagtggggcggcagcggtttgtcctcgctgcttcgggtcggtgtggcgcaaaggcgttatgaaaaacccagcttcttcagcagttttaaaggggaaaggcgcagggatagggaactggatacttcgttgagcctttggcaccgtgcgttgcatattaaaggcatcacaccgcgcctgaccttgtcgcaccgtgaaacatggagtaacgatgtgatgaatgaatacgaaaaaaacagagcgtttattgagtttaacaaaacgttctga

SEQ ID NO: 342 - protein, 477 aa, N. cinerea
MTAQNRWVLLLSLLATAAYAEEIPHGPDLRNKPEFKIHEVEVKPVNREKISEQVQEKGKVLQIDGETLLKNPELLSRAMYSAVVSNNIAGIRVILPIYLKQAQQDKMLALYAQGILAQADGRVKEAVSYYRRLIAVQPDAPAVRLRLAAALFEDKQNEAAADQFDRLKTEDLPPQLMEQVELYRKALRDRDAWKFNGGFSVTQERNINQAPKQQEYGQFTLPKQVNGTAVNYQIGAEKKWSLKDGWYATAGGDLFGRIYPDNTRFNDMTARVSTGAGYSDQRKDIGLTVFHERRTYGNDAYSYANGARVSFDYWLAQKLQMLTAVETGYLKNIRYDRSNNKNLMLSHSLIYYPNARQYWMGGLDLYRERNPADRGDNFNRYGMRFAWGQEWGGSGLSSLLRVGVAQRRYEKPSFFSSFKGERRRDRELDTSLSLWHRALHIKGITPRLTLSHRETWSNDVMNEYEKNRAFIEFNKTF

SEQ ID NO: 343 - DNA, 1413 bp, N. cinerea
atgaacaaactttccctgctcctgctgccgtttccgctggcggcactggccgacgggccgaccgtgctcgtgcccgagccgctgttttttgaaaaccgcgaggcggcgcagatgccgtctgaaaacctgcccgatcctgcgcctgccgcgccgctttcagacggcctttcgccgcaagacggtttggaagcgcaaatcaatcatgcggttttccgccgcgactggcaagctttgccgccgctgctggcgcgttaccgcaatctgcccgcacgcgaccaaacgctttacgattatgcgctgggcgcgttgcgccgcgcccagttgcgccataaggaagcaatcgcgttgtatcgcggcattgtcgggcggcatcccgatttggcctatccgcgttttgacttgggcgtgatgctgtttgaagaccggcaataccgcgccgccgaagccgagctgcaacacgccctgcctgatttgtcacccgaaatgcagaacattgccggccgatatttggctgccgtccgcgaggccgaaagctggcagcccgatgtctcactgcaatacgaggccacggacaatgtgaacaatgccgccgacgcgcgttttatcgaaatcgacggcaaaagatggcagaaaacggctgacagcctgccgcagcgggcacacggcctgcgctacggcgcgtctgtgtcgcgtgaaaaaaatctcggcggacaccattatgcctacgccaaactgggcggcgacggtgtcgcttattgggacaaccatgatttcgacgagcagagcctgaacattgccgcaggctataaaaaccattcggcggcgcgctcgttcggccttgtgccgtttgccgaaaccaattggctgggcggcagccgctacaaccgcgccgatggggtgcaggccgatttttcccgccgtttcggtgcaaaatggcgcgtgatgctgaatgcgggatatgtccgcaaacactatcgggagccgcatattgcagagcgctacaacggcaaaatgccgctggcgggagtaacgctgatgtatgccgcgccaaagggctggctgttttacggaggagcagactggtcgcacgaaatgaccaaagaaacggagcaggcatccgtgcgcaagggcatacgcttcggcgcggtgaaagcgtttgagaacggattcggcatccgcaccaacctgcgctacgcccgtcgtacctttgatgcgccggatagcctggtttaccgcttgacccgtaaggaccatgaatatcaggcaaatgtctctatttggcacaataaaatttcatggaaaggcttggtgccgcatttgaatttccgttatctgaaaatcgacagcaatatgagcggcttctattcccgcaagagtatgcagacattcgtcagcgtggagaagcagttttga

SEQ ID NO: 344 - protein, 470 aa, N. cinerea
MNKLSLLLLPFPLAALADGPTVLVPEPLFFENREAAQMPSENLPDPAPAAPLSDGLSPQDGLEAQINHAVFRRDWQALPPLLARYRNLPARDQTLYDYALGALRRAQLRHKEAIALYRGIVGRHPDLAYPRFDLGVMLFEDRQYRAAEAELQHALPDLSPEMQNIAGRYLAAVREAESWQPDVSLQYEATDNVNNAADARFIEIDGKRWQKTADSLPQRAHGLRYGASVSREKNLGGHHYAYAKLGGDGVAYWDNHDFDEQSLNIAAGYKNHSAARSFGLVPFAETNWLGGSRYNRADGVQADFSRRFGAKWRVMLNAGYVRKHYREPHIAERYNGKMPLAGVTLMYAAPKGWLFYGGADWSHEMTKETEQASVRKGIRFGAVKAFENGFGIRTNLRYARRTFDAPDSLVYRLTRKDHEYQANVSIWHNKISWKGLVPHLNFRYLKIDSNMSGFYSRKSMQTFVSVEKQF

SEQ ID NO: 345 - DNA, 1506 bp, N. cinerea
atgccgaaagccacgtccatgaacaagccgctcctcctcgccttgtgcctgctgcagcccgctcttgcacatgccgatggtcctgccgacgaacgccgccgcctgcttgacgagggcagccgacaaacgcagcaataccgcgaaagcagttggctggacacggaacaggcacgcggggaagtgggggaaaacgacggctacatcatgatagacggtacagtctaccaagttggtgatacggcggaagaactggaaagcgcgatttaccacgccctcaatacgcggcagtggcacaaggtgcggcagttcgctgcccgctacgccaaactgccccggcacaaacccgcgctgattcatttggccgatgcgctgcaaaaacgggacgaaggggatttccgcgcggcggggaacagttttcagacggccttggaagccgaacccgacaacccccgcctgctgctcgaagcggggcggttttatgccgaagacaaccaaaacaaagagtcagccgccgcgtttgagaaagttctgaaaacggatattcctgcagaaacccgctacatcgtggaaaactacctgtccgaactgggcaaacgccgccgctggcacggccaaatcagcctcggctatggttacaacagcaatgtaaaccaaggcaacggcatcaaccaatgcgtgtgggaaatcgcgggcatgtgcctgatggagcgcaccctacctgcgccaacggattcgaccttctcatcctatagcgcgaccgccgaaaaaaccgtcccgctcaaagggcatcacggcgtacaggtgcgcggtgtactgtacggcaaccgctacacggaaaaagacaaagattcggcggccatgccggattacggctatcgcaacggttcgctgtacgcgggatacgcctatgccgacgcacgctcctccttttccctgctgccttatttcgaatacgacttccgcaaccgccacacccactaccgcgcatggggtgcggatgccgactggtcgcgcatactttccccgcgctggcgcatcaacgcccgtgccggagcaaaaaagactggatacggcggacaaagcaaaacttattttgccgatttcaaacaatacgaactcggcgcgggggcggaattttctatcacgccgaaaagcggcctgtttgtaaatttcgatgccgcacgcaaagcctatcccgaaaaatcttcttccagcaaagaatatacggctcggctgggtgcgtataggcttttttcgggcggtacttatttaaacgccgtcctgctctaccgccgcagcctgtatgacgcggcaagtttcatcagcgataacaaacggcggagcgacaagcaatacatcatgatggctgcggcgggttttccgcaatggaatatcaaaggcgtatatcccgaactgcgtttcaggcgaacaatcgcacacagcaacgcggtgtattaccgctaccgccaaaacgaatggctgttgggttttaaatatcggttttga

SEQ ID NO: 346 - protein, 501 aa, N. cinerea
MPKATSMNKPLLLALCLLQPALAHADGPADERRRLLDEGSRQTQQYRESSWLDTEQARGEVGENDGYIMIDGTVYQVGDTAEELESAIYHALNTRQWHKVRQFAARYAKLPRHKPALIHLADALQKRDEGDFRAAGNSFQTALEAEPDNPRLLLEAGRFYAEDNQNKESAAAFEKVLKTDIPAETRYIVENYLSELGKRRRWHGQISLGYGYNSNVNQGNGINQCVWEIAGMCLMERTLPAPTDSTFSSYSATAEKTVPLKGHHGVQVRGVLYGNRYTEKDKDSAAMPDYGYRNGSLYAGYAYADARSSFSLLPYFEYDFRNRHTHYRAWGADADWSRILSPRWRINARAGAKKTGYGGQSKTYFADFKQYELGAGAEFSITPKSGLFVNFDAARKAYPEKSSSSKEYTARLGAYRLFSGGTYLNAVLLYRRSLYDAASFISDNKRRSDKQYIMMAAAGFPQWNIKGVYPELRFRRTIAHSNAVYYRYRQNEWLLGFKYRF

SEQ ID NO: 347 - DNA, 1482 bp, N. cinerea
ttggctgaattgcccaaaggcggtgtccggcaggatgcgccttctcaggatgctgccgtacaggtgcagcaaaaacaatggttggatattttgtctggagaagaaaggtcgtctgaaaaggatgaaaatgttgctaaaccgaatgtaatcggagatgagtttttagcggcaaacccgcgtattcttgagagcgcgctgattcaagcacttaacggcaatagcgcggatttggttttttcgcttgccgccctttaccgcaaacagcccaaccataatccaaagctgattgcacgtgccgatgctttgctggcaaagttgaaagggcggacttccgaagcggtcgagcgttatcgtaccctttatgaatccgacgtttcagacgaccgcatattgttggatttggcggcggcagagtttcaggattatcgtttgagcgaggcggcagcgcatttccatcatgccgcgcaacgcgatatacccgcccccgttttggaaaacgtcaaacgttttcaagaagccgtcaagcggcagacagaatggaaatggtccggcggaatcagccccgtgcataataacaatgccaacaacgctgctccgcgttattgcatcgaaacaagggggcaaaccgcatgcagtgttaccttacctgtcagtgccaacggcttgaattacgaattgaacacagaaaaactcaccccgttgtacgggcatcacgctgtcaaattccgcgccaacctcagcggcacaagctattttttcgaccggaaatcggcttacgacgatgcgtttggcagggcttatttgggctggcagcgcaaggacggcaaacaaaccgtcagcgttttaccgttttatcaggcacagttggcgggcagcagcgaatttgacggcaaaaaagaaaacaaccgccgcgccgtgccttatatgctggcacacggggtcggcattcaggcttcatatacggtcaggttcggacgggatatgcagttttacagttcgttggaacgatatcggcggtaccacagggagaatgcccgtgcggaacgtaatgatggttggcaggacagtctgtatgtgtcgttagcgcggcgtttcggaaattcggcaactgtgtttggcggctggcagtttgcacggtttgttccggaacgcggaatagtgcgtggcgcggttaacaatgcggcgtacaaccgtaacagtatcaatgttggctgggtacggcaatggcaggaattgggtggtttgaacagtcggattgccgtgtcttatgcccgccgcaattataagggtatggccgcattcgctaccgaggcgcagcgtaaccgtgaatggaacgtatcgcttggattgagtcacgaccgtttgtcctacaagggtattgtaccgacgctaacgtacagtttcggtaaaacgagcagcaatatgcggtatgcagaacgctggaatagccagatattgttcggggcggattggcggttttaa

SEQ ID NO: 348 - protein, 493 aa, N. cinerea
MAELPKGGVRQDAPSQDAAVQVQQKQWLDILSGEERSSEKDENVAKPNVIGDEFLAANPRILESALIQALNGNSADLVFSLAALYRKQPNHNPKLIARADALLAKLKGRTSEAVERYRTLYESDVSDDRILLDLAAAEFQDYRLSEAAAHFHHAAQRDIPAPVLENVKRFQEAVKRQTEWKWSGGISPVHNNNANNAAPRYCIETRGQTACSVTLPVSANGLNYELNTEKLTPLYGHHAVKFRANLSGTSYFFDRKSAYDDAFGRAYLGWQRKDGKQTVSVLPFYQAQLAGSSEFDGKKENNRRAVPYMLAHGVGIQASYTVRFGRDMQFYSSLERYRRYHRENARAERNDGWQDSLYVSLARRFGNSATVFGGWQFARFVPERGIVRGAVNNAAYNRNSINVGWVRQWQELGGLNSRIAVSYARRNYKGMAAFATEAQRNREWNVSLGLSHDRLSYKGIVPTLTYSFGKTSSNMRYAERWNSQILFGADWRF

SEQ ID NO: 349 - DNA, 1494 bp, N. elongata
atgacccaccgcctctgcctgcttttcctgccgctctgtacggtctgccttgccgccccgtccgacgatgccgcagacgaacgccgccgcctgctggacgaaagcggccgccaaacgcagcaataccgcgaaagcggttggctggacacggaacaggcacgcgggaaagtgggagaaaacgacggctacatcatgatagacggtacagtctaccaagtcggcgatacggcggaagagctggaaagcgcgatttaccacgccctcaacgcgcggcagtggcacaaggtgcggcagttcgccgcccgctacgccaaactgccgcagcacaagcccgcgctgattcatttggccgatgcgctgcaaaaacgggatgaaggggatttccgcgcggcggggaatagttttcagacggccttggaagtcgaatccgacaacccgcgcctgctgctcgaagcggggcggttttatgccgaagacaaccaaaacaaagagtccgccgccacgtttgagaaagttctgaaaatggatattcccgcagaaacccgccccatcgtggaaaactacctgtccgaactgggcaaacgccgccgccggcacggccaaatcagcctcggttacggctacaacaacaatgtaaaccaaggcaacggcatcagccaatgcgtgtgggaaatcgcgggcatgtgcctgatggagcgcaccctgcccgcgccaacggattcgaccttctcgtcctatagcgcgaccgccgaaaaaaccgtcccgctcaaagggcatcacggcgtacaggtgcgcggcgtgctgtacggcaaccgctacacggaaaaagacaaagattcggcagccatgccggattacggctatcacaacggttcgttgtacgcgggatacgcctatgccgacgcacgctcctccttttccctgctgccctatttcgaatacgacttccgcaaccgccacatccactaccgcgcatggggtgcggatgccgactggtcgcgcacactctccccgcgctggcgtgtcaatgcccgtgccggcgcgaaaaagaccggatacggcggacaaagcaaaacttattttgccgatttcaaacaatacgaactgggcgcgggggcggaattttccatcacgccgaaaagcggcctgcttgccaacttcgatgccgcccgcaaagcctatcccgaaaaatcctcttccagcaaagaatatacggcacggctgggtgcgtataggcttttttcgggcggtacttatttaaacgccatcctgctctaccgccgcagcctgtatgacgcggcaagtttcgtcagcgacaacaggcggcggcgcgacaagcaatacatcatgatggctgcggcgggttttccgcaatggaatatcaaaggcgtataccccgaactgcgcttccgccgcaccatcgcccgcagcaacgcggtgtattaccgctaccgccaaaacgaatggctgttgagcttgaagtatcggttttga

SEQ ID NO: 350 - protein, 497 aa, N. elongata
MTHRLCLLFLPLCTVCLAAPSDDAADERRRLLDESGRQTQQYRESGWLDTEQARGKVGENDGYIMIDGTVYQVGDTAEELESAIYHALNARQWHKVRQFAARYAKLPQHKPALIHLADALQKRDEGDFRAAGNSFQTALEVESDNPRLLLEAGRFYAEDNQNKESAATFEKVLKMDIPAETRPIVENYLSELGKRRRRHGQISLGYGYNNNVNQGNGISQCVWEIAGMCLMERTLPAPTDSTFSSYSATAEKTVPLKGHHGVQVRGVLYGNRYTEKDKDSAAMPDYGYHNGSLYAGYAYADARSSFSLLPYFEYDFRNRHIHYRAWGADADWSRTLSPRWRVNARAGAKKTGYGGQSKTYFADFKQYELGAGAEFSITPKSGLLANFDAARKAYPEKSSSSKEYTARLGAYRLFSGGTYLNAILLYRRSLYDAASFVSDNRRRRDKQYIMMAAAGFPQWNIKGVYPELRFRRTIARSNAVYYRYRQNEWLLSLKYRF

SEQ ID NO: 351 - DNA, 1404 bp, N. elongata
atgaaaatagcctccctgctcctgctgcttttacccttccacgccgtatccgaaaccgtgcacgttcccgcaccggtttccttcgaccgactgccggaaacacccatcagctccgagccgccgccccaacccgcaccgcccgccgccgtcctttccgacgacaacggcagcaccctggaagcgcaaattagccgcgcactgaccgaacaagactggccgcgcctgacaaaactgctgcaaaaataccaaaccctgcccgcgcgcgaccccatcctccacgactacgcactcggcgcactccgccgcacccaactccgtcacgatgaagccgtcgcactgtatcgcggcatcttggcgcaacagcccgacttggcctatccgcgttttgatttgggtgtcatgctgtttgaaaacaaacaataccgcgaagcggctgcggaactgcaacgtgccaaacccggcctgcagcccgacatgcaaacactggccgaccgttatctggcagccatcaaaaaagaacaaggctggcagcccgaaatttccctgcaatacgccgctaccgacaatgtaaacaacgcttccgaagccgaaatcatcgaatgggacggcaggcaatggcggaaaaccgccgacagcctgccccaaagcgcgcacggtatccgctacggcttgggcgtatcgcgcgaaatcaacttgggcggccgccacttcgccgcaggccgtctgaacggcgacggcgtacattattggggccgccgcgaatacaacgagcagagcatccaccttgccgcaggctacaaaaaccgctccgtaacgcgctcgttcggcatcctgccctttatcgaatacaaccggctgggcggcgaaccttacaaccgagtattcggcgcacaggccgacttttcaggccgtctgaacgacaaatggcgcatcgcgctcaacgcgggccatatctggaaacgctatcgcgaagaacgcacggcggcacgttacgacggccacatgccgtcggcgggcgcaaccctgatatacgccgcaccgaaaaactggctgctgtccggcggtgcagactggtcgcacgacatcacgcgcgaagcggaacaggcttccgtgcgcaaaggcgttcggctgggcgtattcaaaaccttttcagacggcctcggcctgcgcaccaacctgcgctactcccgccgtgttttcgacgcgcccggcacgctggtttaccgcttcgtgcgcaaagaccgcgaatatcaggccggcgcatccgtctggcacgaaaaattgtcgtggaaaggcttggtgccgcgcctgaacctgcaatacctgaaagtggacagcaatatgggcggcttctattcgcgacggaatatgcaatggtttgtcagcgtggagaaacagttttaa

SEQ ID NO: 352 - protein, 467 aa, N. elongata
MKIASLLLLLLPFHAVSETVHVPAPVSFDRLPETPISSEPPPQPAPPAAVLSDDNGSTLEAQISRALTEQDWPRLTKLLQKYQTLPARDPILHDYALGALRRTQLRHDEAVALYRGILAQQPDLAYPRFDLGVMLFENKQYREAAAELQRAKPGLQPDMQTLADRYLAAIKKEQGWQPEISLQYAATDNVNNASEAEIIEWDGRQWRKTADSLPQSAHGIRYGLGVSREINLGGRHFAAGRLNGDGVHYWGRREYNEQSIHLAAGYKNRSVTRSFGILPFIEYNRLGGEPYNRVFGAQADFSGRLNDKWRIALNAGHIWKRYREERTAARYDGHMPSAGATLIYAAPKNWLLSGGADWSHDITREAEQASVRKGVRLGVFKTFSDGLGLRTNLRYSRRVFDAPGTLVYRFVRKDREYQAGASVWHEKLSWKGLVPRLNLQYLKVDSNMGGFYSRRNMQWFVSVEKQF

SEQ ID NO: 353 - DNA, 1557 bp, N. flavescens
atggcactcggtttgcaaaatttccgactcaaaacattgtacaatctgaccacttataccgataacatcccaaacattgccatgaaaaaacgtctgctcctcctcgccatccttcccctttcccttcacgccgccgatgtaccgcctgatgtaaaacccgagcttcaagtcaacactgccgaaccccaacaacccgaaacgcacaacatccctgccgagcagacaaacaggccgtctgaaaaaatcatcaacgtcgatgccgacaccctgcttgccaataccgaattactggcacgcgccatgtattccgccgtcgtcgcccataatatccccggcatcaaagccgttttgcccatttacgaacaatggcctgaacacgaccgcgccatggcacgctatgccaaaggtttgcttgcccaatccgaagggagagctgccgaagccatcggccattaccgccgctttatcgccgagcagcccgatgcctccgccgtccgctggcagcttgcgaccgccttgtttgaagacaaacaaaacgaagccgcagccgaccagttcgacaaactgcaaaccgaatccctcccgcctgccttgcaagaacgcatcgaaacataccgcaaaaccctgcgcgaacgcgactcatggcaattcaatgccggcttgaacatcacacgcgaacaaaacatcaaccaagcccccggccaacgccgtctgggcaaccacctgagcgatgaacaatgccgcgccgagcgccttatccatcctaacgacgactgcttccgaggctggacattccccgaacccatcgatgccaccgccatccactatcaaatcggcgcagaaaaaaaatggtcgctgccacacggcttctatgccacggcaggcgcagaccattacggcaaaatctaccccaaacacaccaactacaacgacctcaccacacgcttctcggcaggcatcggctatgccgaccagcgcagcgatatcggcataaccccgttccacgaacgccgcttctacggcaacgacccctacacctacaccaacggcgcacgcctccactacaaccattggtggcaaccaaagctgcaaaccctcagcgcatttgaagcaggccgtctgaaaaacagccgccgcgagcattccaacaataccagccaactactcagcaactccatcgtgtactaccgcaacgcgcgccaatactgggtagccggtatcgacctctaccgcgaacgcaaccgcgacgacaaaagcgacagcttcaaccgctatgccctgcgcaccacatggggacaagaatggcccaaaggcctctctaccgtcctacgcctcagcgccgcccaacgccgttaccaaggccccagcctcttcagcaacgaacaaaaccgccgcgacaaagaagcctccgcctccctgagcgtatggcaccgcgccctccatttcaaaggcatcaccccgcgcctgaccattgcccacaacaaaacatggagcaacgacaagttctacgaatatggcaaaaccaaaatgtttgtcgaattgagcaaaacgttctga

SEQ ID NO: 354 - protein, 518 aa, N. flavescens
MALGLQNFRLKTLYNLTTYTDNIPNIAMKKRLLLLAILPLSLHAADVPPDVKPELQVNTAEPQQPETHNIPAEQTNRPSEKIINVDADTLLANTELLARAMYSAVVAHNIPGIKAVLPIYEQWPEHDRAMARYAKGLLAQSEGRAAEAIGHYRRFIAEQPDASAVRWQLATALFEDKQNEAAADQFDKLQTESLPPALQERIETYRKTLRERDSWQFNAGLNITREQNINQAPGQRRLGNHLSDEQCRAERLIHPNDDCFRGWTFPEPIDATAIHYQIGAEKKWSLPHGFYATAGADHYGKIYPKHTNYNDLTTRFSAGIGYADQRSDIGITPFHERRFYGNDPYTYTNGARLHYNHWWQPKLQTLSAFEAGRLKNSRREHSNNTSQLLSNSIVYYRNARQYWVAGIDLYRERNRDDKSDSFNRYALRTTWGQEWPKGLSTVLRLSAAQRRYQGPSLFSNEQNRRDKEASASLSVWHRALHFKGITPRLTIAHNKTWSNDKFYEYGKTKMFVELSKTF

SEQ ID NO: 355 - DNA, 1470 bp, N. flavescens
atgaaaccaagaaatctcttttttgcaggctgcctgctgacttcggcggtgtttgccgaggatgttgccgtgcctgtcgaaccgattaacgtcggtaatcggattgcgatgccgtctgaagggggaaaccttgctcctttaccgcttgttgaggatattgccgtgcctgtcgagccgattaatgtcatgccgtctgaagcttctaaaagtgcggcaggcggcgatgttcgagacgatcggataggaatgcagattaatcgggcgttgttggcgcgggactgggcggcactgaaacgcctgttggtccaatatgccgaacagccgcaatatgatacggtgctgtaccgttatgccctcggcgcgttataccgcagcgagatgcggcagggcgaggcggccgatctataccgtgagttgttgtcggaaaggcctgaccttgtttatccacgttttgatttgggtgtgatgctgtttgaagacaaacaataccgtgaggcattggttcagttgcgccgggtcggggaggcgttgccgcccgatatgcggcagcttgcacgaaaatatatccgtcaggcagaagcggtgcaggcgtggcatccttcgttcagtatgaactatgaacaaacagataatgtaaacaatgcttccccttcacgggacatcatcctcaacggccggaaatggacaaaatcggaagacagcctgcccaaacgcgccaacgggataaggtacgaactgggtattgaccggatgtttaacattgcaggtaatcactttgcccgcttaggcatcagcggttccggtgtgcattattggaatgcccgggattttagcgaacaggcgtttcatgccgaagtaggctaccgttatcggaatagccgtctagagtggggattccggccctttgtcgaacaaaaccggctgggcaataaccgttatacggcaaatacgggtattgcgttggattacagccgccgtctgaatgaaaaatggcacagcacccaatctctccagtatggccgcaaacaataccatgacgaatatttggcaaaacgttacaacagcaaaacgatttcagtcagcagtacgttcagctattacgctatgccggcttggcagttgtacggaggtattagcggtatgtttgataatactgtggagaaagagcaggcttcacggcgttatggtgtaagtttgggtacggtgaaaatattagacggcggtctcggactgaagttgggtgcaggttacacgaaacggatatttaaagcccctgcaacattaatttacaattttacccggcgcgatgatgagtatcggataaacgcggctttatggcataaaaaactgtcgtggaaaggatttacaccccaaataaatttccgttacaacaagatcaacagtaatatgcccgccttttattcgcgcagcggcaaggaatggtttgtcagtatagaaaaaacgtattga

SEQ ID NO: 356 - protein, 489 aa, N. flavescens
MKPRNLFFAGCLLTSAVFAEDVAVPVEPINVGNRIAMPSEGGNLAPLPLVEDIAVPVEPINVMPSEASKSAAGGDVRDDRIGMQINRALLARDWAALKRLLVQYAEQPQYDTVLYRYALGALYRSEMRQGEAADLYRELLSERPDLVYPRFDLGVMLFEDKQYREALVQLRRVGEALPPDMRQLARKYIRQAEAVQAWHPSFSMNYEQTDNVNNASPSRDIILNGRKWTKSEDSLPKRANGIRYELGIDRMFNIAGNHFARLGISGSGVHYWNARDFSEQAFHAEVGYRYRNSRLEWGFRPFVEQNRLGNNRYTANTGIALDYSRRLNEKWHSTQSLQYGRKQYHDEYLAKRYNSKTISVSSTFSYYAMPAWQLYGGISGMFDNTVEKEQASRRYGVSLGTVKILDGGLGLKLGAGYTKRIFKAPATLIYNFTRRDDEYRINAALWHKKLSWKGFTPQINFRYNKINSNMPAFYSRSGKEWFVSIEKTY

SEQ ID NO: 357 - DNA, 1461 bp, N. flavescens
atgctaaaaataaaacaaaaacttgtctcggcttctttatgctgcctattgccgtcagcagcctttgctgaatttcccgaaggtgttgtccggctggatgcgccttctcaggatgctgccgtacaagtgcagcaaaaacaatggctggatattttgtccgaagaagaaaggtcgtctgaaaagaatgagaatgtcggcgaaccgactgtggtcggcgatgattttttagcggcaaacccgcgtattcttgaggacgcgctgattcaagcactcaacggcaatagcgcagatctggtttcctcgcttgtcgccctttaccgcaaacagcccaaccacaatcccaaactgattgcgcgtgccgatgctttgctggcaaagttgaaaggacggacttccgaagcggtcgaacgttatcgtaccctttatgaatccgacgtttcagacgaccgcatattgttggatttggcggcaacagagtttcaggattatcgtttgggcgaggcggcggcgcatttccgccatgccgcgcaacgcgatatacctgcccccgttttggagaatgtcaaacgttttcaagaagccgtcaaacggcagacagaatggaaatggtctggcggaatcagccccgtgcataacaataatgccaacaacgctgctccgcgttattgcatcgaaacaagggggcaaaccgcatgcagcgttactttgcccgtcagtgccaacggcttgaattacgaattgaacaccgaaaaactcaccccactgtacgggcatcacgccgtcaaattccgcgccaaccttagcggaacgagctattttttcgaccgtcaatcggcttacgacgatgcgttcggcagggcttatttgggatggcagcgcaaggatggcaaacaaaccatcagcgttttaccgttttatcaggcacagttggcaggcagcagcgagtttgacagcaaaaaagaaaataaccgtcgcgccgcgccgtatatgctggcacacggggttggcgtacagctttcgcatatggtccatctcggcaacgcgacacaactttattactcgctggaacgatatcgccaaaactatcgggaaactgatcgtgcactgcgcaacgatgggtggcacgacagtgcttatctttccctagcgcgccgtttcggcagtacgaccctgttcggcggttggcaatacaaccgctttgttcctgaaaacaaaaacatacgcaatgccgtcaacaatgcggcctaccaccgcaacggtttcaatataggttggatacagcaatggcaggttttaggcgggcttaacagcagacttaccgctttaccgcttcatttgccaaccgtcgctataaaggcattatggcattcggtacggagtcgcaacgcaaccgggagcgctccctctctatcagccttagtcacaacaaattatcttataaaggcattacccctactttga

SEQ ID NO: 358 - protein, 486 aa, N. flavescens
MLKIKQKLVSASLCCLLPSAAFAEFPEGVVRLDAPSQDAAVQVQQKQWLDILSEEERSSEKNENVGEPTVVGDDFLAANPRILEDALIQALNGNSADLVSSLVALYRKQPNHNPKLIARADALLAKLKGRTSEAVERYRTLYESDVSDDRILLDLAATEFQDYRLGEAAAHFRHAAQRDIPAPVLENVKRFQEAVKRQTEWKWSGGISPVHNNNANNAAPRYCIETRGQTACSVTLPVSANGLNYELNTEKLTPLYGHHAVKFRANLSGTSYFFDRQSAYDDAFGRAYLGWQRKDGKQTISVLPFYQAQLAGSSEFDSKKENNRRAAPYMLAHGVGVQLSHMVHLGNATQLYYSLERYRQNYRETDRALRNDGWHDSAYLSLARRFGSTTLFGGWQYNRFVPENKNIRNAVNNAAYHRNGFNIGWIQQWQVLGGLNSRLTALPLHLPTVAIKALWHSVRSRNATGSAPSLSALVTTNYLIKALPLL

SEQ ID NO: 359 - DNA, 1470 bp, N. gonorrhoeae
atggttattttttatttttatttttgtgggaagacatttatgcctgcacgaaacagatggatgctgctgcctttattggcaagcgcggcatacgccgaagaaacaccgtgcgaaccggatttgagaagccgtcccgagttcaggcttcatgaagcggaggtcaaaccgatcgacagggagaaggtaccggggcaggtgcgggaaaaaggaaaagttttgcaggttgacggcgaaaccctgctgaaaaatcccgaattgttgtcgcgtgccatgtattccgcagtggtctcaaacaatattgccggtatccgcgtgattttgccgatttacctacaacaggcgcggcaggataagatgttggcactttatgcacaagggattttggcgcaggcagagggcagggtgaaggaggcggtttcccattaccgggaattgattgccgcccaacccgacgcgcccgccgtccgtatgcgtttggcggcggcattgtttgaagacaggcagaacgaggcggcggcagaccagttcgaccgcctgaaaacagaagatctgccgccgcagcttatggagcaggtcgagctgtaccgcaaggcattgcgcgaacgcgatgcgtggaaggtaaacggcggtttcagcgttacccgcgaacacaatatcaaccaagccccgaaacagcagcagtacggcaattggactttcccgaaacaggtggacggcacggcagtcaattaccggttcggcgcggagaaaaaatggtcgctgaaaaacggctggtacacgacggcgggcggcgacgtgtccggcagggtttatccggggaataagaaattcaacgatatgacggcaggtgtttccggcggcatcggttttgccgaccggcgtaaagatgtcgggctggcagtgttccacgaacgccgcacctacggcaacgacgcttattcttacgccaacggcgcacgcctttatttcaaccgttggcaaaccccgagatggcaaacgctgtcttcggcggagtgggggcgtttgaagaatacgcgccgggcgcgttccgacaatacccatttgcaaatttccaattcgctggtgttttaccggaatgcgcgccaatattggacgggcggtttggatttttaccgcgagcgcaaccccgccgaccgtggcgacaatttcaaccgttacggcctgcgctttgcctgggggcaggaatggggcggcagcggcctgtcttcgctgttccgcctcggcgtggcgaaacggcattatgaaaaacccggcttcttcagcagttttaaaggggaaaggcgcagggataaagaatcggacacatccttgagcctttggcaccgggcattgcatttcaaaggcatcacgccgcgcctgacgctgtcgcaccgcgaaacgtggagcaacgatgtgtttaacgaatacgagaaaaacagggcgtttgtcgagtttaacaaaacgttctga

SEQ ID NO: 360 - protein, 489 aa, N. gonorrhoeae
MVIFYFYFCGKTFMPARNRWMLLPLLASAAYAEETPCEPDLRSRPEFRLHEAEVKPIDREKVPGQVREKGKVLQVDGETLLKNPELLSRAMYSAVVSNNIAGIRVILPIYLQQARQDKMLALYAQGILAQAEGRVKEAVSHYRELIAAQPDAPAVRMRLAAALFEDRQNEAAADQFDRLKTEDLPPQLMEQVELYRKALRERDAWKVNGGFSVTREHNINQAPKQQQYGNWTFPKQVDGTAVNYRFGAEKKWSLKNGWYTTAGGDVSGRVYPGNKKFNDMTAGVSGGIGFADRRKDVGLAVFHERRTYGNDAYSYANGARLYFNRWQTPRWQTLSSAEWGRLKNTRRARSDNTHLQISNSLVFYRNARQYWTGGLDFYRERNPADRGDNFNRYGLRFAWGQEWGGSGLSSLFRLGVAKRHYEKPGFFSSFKGERRRDKESDTSLSLWHRALHFKGITPRLTLSHRETWSNDVFNEYEKNRAFVEFNKTF

SEQ ID NO: 361 - DNA, 1614 bp, N. gonorrhoeae
atgcgccgcgtccgccgcgcgtggggcttgcggcgtttctgccgccgccgtccggcggtgttttttaaggaaggcaaattgaaggatagtgtgtatcgggtatgccggctgtgtgccgcgctgtgtgtttggggtgcggtcggcgcgtatgccgccggcttgcccgacgttcgggacgatgcggcggcgttgcgcgcccagcgtgcggctgcggagggttgggcgggaatgccgccggaaggggattctgccgcaaacggcggttcgcgcgtaatcgacggggatttcctgctgtcgcgcccgcagttgttggaacacgttttgcgcgacgcgctcaacggcaatcaggcggatttgatcgcttcgttggcggatttgtatgccaagctgccggattatgatgcggtgttgtacggcagggcgcgggctttgctggcgaaattggcgggaaggccggcggaggcggtggcgcgctatcgggcgttgcacagggataatgcggcagacgagcgggttttgctggatttggcggcggcggagtttgacgatttccggctgaagtcggcagggctgcattttgcggaggcggcaaaattggatttgccggcgccggttttggaaaatgtggggcgtttccggaaaaaaacggaggggctgacgggctggcatttttcgggcggcatcagcccttctgtgaacaaaaacgccaacaatgccgcgccgcaatactgcctgcagggcggcggcagccggatatgcagcgttaccggacctgtccgtgcggcagggttggattatgaggccggggcggaaaagctgactgcgctggcggacaaccattatctgctgttccgcgccaatgtcgggggcacaagctattatttcagccgcaaatcggcttatgacgatgctttcggcagggcttatttgggctggcagtataaaaatgcgcggcagacggtgggggttttgccgttttatcaggcgcaattgtcgggtagcgacggctttgatgcgaaaacgaaaccgcctgccgaccgccggcttgcgccgtatatgctggcgcacggggcgggtgtgcagttggcgcattcttaccgcctgagccgccggtcgcagctttcggtgtcgctggaacgttaccgccaacgctaccgcgaacaaggccgggcggaacgcaacgacggttggcaggacgggctttatgtgtcgctggcaaggcggttgggcggctcggcaaccgtgttcggcggctggcagtttgcgcggtttgtgccgaaacgcgaaacggtgggcggcgcggtcaacaatgccgcctaccgccgcaacgccgtccatatcggttgggcgcaggagtggggcgggacgggcggtttgaacagccggattgccgcgtcttacgcccaccgcaactacaaaggcattgcggcattttcgacggaggcgcagcgtaaccgcgaatggaatgtctcgctggctttgagccacgacaagttgtcatacaaaggcatcgtgccgacgttgaactaccgcttcggtaagacggaaagcaatgtgccgtatgcaaaacgccgcaacagcgaggtgtttgtgtcggcggattggcggttttga

SEQ ID NO: 362 - protein, 537 aa, N. gonorrhoeae
MRRVRRAWGLRRFCRRRPAVFFKEGKLKDSVYRVCRLCAALCVWGAVGAYAAGLPDVRDDAAALRAQRAAAEGWAGMPPEGDSAANGGSRVIDGDFLLSRPQLLEHVLRDALNGNQADLIASLADLYAKLPDYDAVLYGRARALLAKLAGRPAEAVARYRALHRDNAADERVLLDLAAAEFDDFRLKSAGLHFAEAAKLDLPAPVLENVGRFRKKTEGLTGWHFSGGISPSVNKNANNAAPQYCLQGGGSRICSVTGPVRAAGLDYEAGAEKLTALADNHYLLFRANVGGTSYYFSRKSAYDDAFGRAYLGWQYKNARQTVGVLPFYQAQLSGSDGFDAKTKPPADRRLAPYMLAHGAGVQLAHSYRLSRRSQLSVSLERYRQRYREQGRAERNDGWQDGLYVSLARRLGGSATVFGGWQFARFVPKRETVGGAVNNAAYRRNAVHIGWAQEWGGTGGLNSRIAASYAHRNYKGIAAFSTEAQRNREWNVSLALSHDKLSYKGIVPTLNYRFGKTESNVPYAKRRNSEVFVSADWRF

SEQ ID NO: 363 - DNA, 1494 bp, N. gonorrhoeae
atgacccaccgcctctgcctgcttttcctgccgctctgtacggtctgccttgccgctccgtccaacgatgccgccgacgaacgccgccgcctgctggacgagggcagccgccaaacgcagcaataccgcgaaagcggttggctggacacggaacaggcacgcggggaagtagaggaaaacgacggctatatttcgataggcggcgaaatctaccaagtcggcgatacggcggaagaactggaaagcgcaatttaccacgccctcaatgcgcggcagtggcacaaggtgcggcagttcgccgcccgctacgccaaactgccccggcacaagcccgcgctgattcatttggccgatgcgctgcaaaaacgggacgaaggggatttccgcgcggcggggaacagttttcagacggccttggaagccgaacccgacaacccgcgcctgctgctcgaagcggggcggttttatgccgaagacaaccaaaacaaagagtctgccgccgcgtttgagaaagttctgaaaacggacattcccgcagaaacccgccccatcgtggaaaactacctgtccgaactgggcaaacgccgccgctggcacggccaaatcagcctcggctacggctataacagcaatgtaaaccaaggcaacggcatcaaccaatgcgtgtgggaaattgcgggcatgtgcctgatggagcgcaccctgcccgcgccaacggattcgaccttctcatcctatagcgcgaccgccgaaaaaaccgtcccgctcaaagggaatcacggcgtacaggtgcgcggtgtactgtacggcaaccgctacacggaaaaagacaaagattcggcggctatgccggattacggctatcgcaacggttcgctgtacgcgggatacgcctatgccgacgcacgctcctccttttccctgctgccttatttcgaatacgatttccgcaaccgccacacccactaccgagcatggggtgcggatgccgactggtcgcgcacactctccccgcactggcgcattaactcacatgccggagcaaaaaagaccggatacggcggacaaagcaaaacttattttgccgatttcaaacaatacgaactcggcgcgggggcggaattttccatcacgctgaaaagcggcctgcttgtaaatttcgatgccgcacgcaaagcctatcccgaaaaatcctcttccagcaaagaatatacggctcggctgggcgcgtataggcttttttcgggcggtacttatttaaacgccgtcctgctctaccgccgcagcctgtatgacgcggcaagtttcgtcagcgataacaaacggcggcgcgacaagcaatacatcatgatggctgcggcgggttttccgcaatggaatatcaaaggcgtatatcccgaactgcgtttcaggcgaacaatcgcacacagcaacgcggtgtattaccgctaccgccaaaacgaatggctgttgggttttaaatatcggttttga

SEQ ID NO: 364 - protein, 497 aa, N. gonorrhoeae
MTHRLCLLFLPLCTVCLAAPSNDAADERRRLLDEGSRQTQQYRESGWLDTEQARGEVEENDGYISIGGEIYQVGDTAEELESAIYHALNARQWHKVRQFAARYAKLPRHKPALIHLADALQKRDEGDFRAAGNSFQTALEAEPDNPRLLLEAGRFYAEDNQNKESAAAFEKVLKTDIPAETRPIVENYLSELGKRRRWHGQISLGYGYNSNVNQGNGINQCVWEIAGMCLMERTLPAPTDSTFSSYSATAEKTVPLKGNHGVQVRGVLYGNRYTEKDKDSAAMPDYGYRNGSLYAGYAYADARSSFSLLPYFEYDFRNRHTHYRAWGADADWSRTLSPHWRINSHAGAKKTGYGGQSKTYFADFKQYELGAGAEFSITLKSGLLVNFDAARKAYPEKSSSSKEYTARLGAYRLFSGGTYLNAVLLYRRSLYDAASFVSDNKRRRDKQYIMMAAAGFPQWNIKGVYPELRFRRTIAHSNAVYYRYRQNEWLLGFKYRF

SEQ ID NO: 365 - DNA, 1416 bp, N. indicus
atgatctcgggctccatgcatgaaaaagcgtgcgccccgtcccgcgaagggacggggctgttcagcgtaagggtttcgagtttgcgcagtctgttcttggccgctctcatgtgcctcggagcgatcaccggccccgctgtctcggcgccggcggccgaaggaggcagcacggctatcgtttccagtgcgcaggcagtcgccacggtgcgcagtctcgtcgatgcaggtcgcttcgaggaggcgcgcggcttcattgcccggtggaatgcgggcagccgcagtcactccatgcgcgttgcgttcgttgaaggtttgattgctgcgcgttccggcaggcacgctcaggctgcggccatcttccgggaaatattggctgtcgacccacagaacgatgtggcgcgcatagagctcgcccgctcgcttgccgcgctcaacgatgccgatggcgtgcgcgcccaggccgagcttctgcgagcctcgggcatcgatgatcgattgggcggagcgatcacccggcttgccgatctggtcgatgcaggccggccactgcggttccgcggttatctgtcgcttctcccctcaaccaacatcaaccggggtacggacaacgagaccgtggccttcggtcccatcgacctgcggatcaatccggacgcgcgacgcaagtccggtatcggccttctgctcggtggcgagatgatttaccagaagccgctcagccccacgcgccgattgatttccgtgacgagcgcgacaggacgcttctatccgaaactgccttctgcctcctcattgcaggttgatggcgcgctcggcgtcgagcaacgcatcggcagtacaagggcgatggtcgctctgacgggaagcatcgtggtgacgcccgatgccgtcaccaccgttcagacgggtatccgcggcgagttgtccggccgctttgccgcagcacctcgttggttctggtatctgggcggtcaggcccgcatccaggacgatctcgtttcggatgcccgcgatggctatgtggccaatttaggcttcaatctagaccgtatgttcgctaccggccacttcatccgcttcggcgtgcgcggcgagctagcccggctacgggaaggccgtttttcctatgacgaggcaggcctgcttgttggatatgcgcgcccgctgcctttgggcatcaacgtttttgcacaagctgcattgtcatggcgcgattatcacgggctttatcccggtcttgacgaaggccagagcgacatacgcttcaccggcgacatcatagccaccaagcgtgacctgcacatcgccggttttgcgccgcagctgcaatatcgcttcgagcgcgtttcctccaacgctgcctttgaggactacacccgccatgaggtcgagctgcgtctgaccaaagacttctag

SEQ ID NO: 366 - protein, 471 aa, N. indicus
MISGSMHEKACAPSREGTGLFSVRVSSLRSLFLAALMCLGAITGPAVSAPAAEGGSTAIVSSAQAVATVRSLVDAGRFEEARGFIARWNAGSRSHSMRVAFVEGLIAARSGRHAQAAAIFREILAVDPQNDVARIELARSLAALNDADGVRAQAELLRASGIDDRLGGAITRLADLVDAGRPLRFRGYLSLLPSTNINRGTDNETVAFGPIDLRINPDARRKSGIGLLLGGEMIYQKPLSPTRRLISVTSATGRFYPKLPSASSLQVDGALGVEQRIGSTRAMVALTGSIVVTPDAVTTVQTGIRGELSGRFAAAPRWFWYLGGQARIQDDLVSDARDGYVANLGFNLDRMFATGHFIRFGVRGELARLREGRFSYDEAGLLVGYARPLPLGINVFAQAALSWRDYHGLYPGLDEGQSDIRFTGDIIATKRDLHIAGFAPQLQYRFERVSSNAAFEDYTRHEVELRLTKDF

SEQ ID NO: 367 - DNA, 1488 bp, N. lacisaponensis
atgtttaatctacacataacacgctggcaggtgggtggtttatggactgtcttgttgctgttggcgatgcctctggctgcgcaggatgctgatgtgcagctgcgtttgcaacagagtctggatcagcaggctgaaacgctggagcggcgcttactggctgatgaagactatcagcctgccgggcagccacagctgattattgaaggccgcgcgtatcctgttggggataatgttgatgatctcgggcgagcactctatgtggcgctacagcaacgtcagtggtctgcggtggtgtattttctgcagcgctatgccgcactggaggatgctgatccgatgctgttggccttcgcacaaggctccctggctcgggtgcagggtgatttacgcggtgccgaagcatttttccgacaattgctgcttttgcaaccgggcttcctgccagggcagctggagttggcgcgggtgttgttcgaaaatcataagaaccctgaagcctatcaatcatttgagcagattgcggcacagttggacccgctcgatgagcgtcagacgggtgtacgccgtactgtacagaattttttgcaggcgttggatcagcgccatgcctggcaaggatcggtggcttttggacctatctggaatgacaacctgaatcagtcatcgggtagccgtacctgtctgctggagcttaacggtcagtgttattacgaacgtaaagtgccggatgcgctggctgcgaccggtgtggattatgagtttagcctgaatcgtcagttcagcttgtcagggcatcatggcatgtatgtgcgtgcgctctggtatgggcaatcctatgacgaaacgcgtgagtataatgagagtacgttgaatctgcagtcaggctatcgttatcaggatcagcgtcaccagtttcgactggcacctgtcgttgaattgaccgctcagggtgacaaagtgctgcatgatgcctggggtgtgcatgccgaatggatgtatcacctgaatccccggcgtgtttttaagctggagggtagttcacggcagttgcgctatcaggatgaccggtttgatcgttacaacggcccttctcatgctgtacatgcgacggtttggcaggtgttgcccaataactggacggcatttaccggtctggactggcagtaccgtgatgcggaggatgaaaccctggcgtatcagcaaccgggcttgcgtctgggtatggctggcgctttgaatcagcatctgcacacaacgttattgttgtcgcatcgcgagcggcggcatcaggcatttagtgctgtgctgggtgaaagacgcagtgatgatgagcagagtgtaacactgatactgcgtgcaccaacattgcaggttgccggttttgaacccgtgctaacgcttcgccaccgaaaaattcgcagcaatgtcgactggctttacagccatgaccgtaatcaggtgagcctgaagctggaacgacgcttctga

SEQ ID NO: 368 - protein, 495 aa, N. lacisaponensis
MFNLHITRWQVGGLWTVLLLLAMPLAAQDADVQLRLQQSLDQQAETLERRLLADEDYQPAGQPQLIIEGRAYPVGDNVDDLGRALYVALQQRQWSAVVYFLQRYAALEDADPMLLAFAQGSLARVQGDLRGAEAFFRQLLLLQPGFLPGQLELARVLFENHKNPEAYQSFEQIAAQLDPLDERQTGVRRTVQNFLQALDQRHAWQGSVAFGPIWNDNLNQSSGSRTCLLELNGQCYYERKVPDALAATGVDYEFSLNRQFSLSGHHGMYVRALWYGQSYDETREYNESTLNLQSGYRYQDQRHQFRLAPVVELTAQGDKVLHDAWGVHAEWMYHLNPRRVFKLEGSSRQLRYQDDRFDRYNGPSHAVHATVWQVLPNNWTAFTGLDWQYRDAEDETLAYQQPGLRLGMAGALNQHLHTTLLLSHRERRHQAFSAVLGERRSDDEQSVTLILRAPTLQVAGFEPVLTLRHRKIRSNVDWLYSHDRNQVSLKLERRF

SEQ ID NO: 369 - DNA, 1467 bp, N. lactamica
atggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccaatcgacagggagaaggtaccggggcaggtgcgggaaaaaggaaaagttttgcagattgacggagaaaccctgctgaaaaatcccgaattgctgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaagaagcgatttcccattaccgggaattgattgccgcccaacccgacgcgcccgccgtccgtatgcgtttggcggcggcattgtttgaagacaggcagaacgaggcggcggcagaccagttcgaccgcctgaaggcggaaaacctgccgccgcagcttatggagcaggtcgagctgtaccgcaaggcattgcgcgaacgcgatgcgtggaaggtaaacggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacgggggggggcgacgtgtccggcagggtttatccggggaataagaaattcaacgatatgacggcaggtgtttccggcggcatcggttttgccgaccggcgtaaagatgtcgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggacgggcggtttggatttttaccgcgagcgcaaccccgccgaccgtggcgacaatttcaaccgttacggcctgcgctttgcctggggacaggaatggggcggcagcggcctgtcttcgctgttgcgcctcggcgcggcgaaacggcattatgaaaaacccggctttttcagcggttttaaaggggaaaggcgcagggataaagaattggacacatccttgagcctttggcaccgggcattgcatttcaaaggcatcacgccgcgcctgacgctgtcgcaccgcgaaacgtggagtaacgatgtgttcaacgaatacgagaaaaatcgggcgtttgtcgagtttaacaaaacgttctga

SEQ ID NO: 370 - protein, 488 aa, N. lactamica
MVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIAAQPDAPAVRMRLAAALFEDRQNEAAADQFDRLKAENLPPQLMEQVELYRKALRERDAWKVNGGFSVTREHNINQAPKRQQYGKWTFPKQVDGTAVNYRLGAEKKWSLKNGWYTTGGGDVSGRVYPGNKKFNDMTAGVSGGIGFADRRKDVGLAVFHERRTYGNDAYSYTNGARLYFNRWQTPKWQTLSSAEWGRLKNTRRARSDNTHLQISNSLVFYRNARQYWTGGLDFYRERNPADRGDNFNRYGLRFAWGQEWGGSGLSSLLRLGAAKRHYEKPGFFSGFKGERRRDKELDTSLSLWHRALHFKGITPRLTLSHRETWSNDVFNEYEKNRAFVEFNKTF

SEQ ID NO: 371 - DNA, 1518 bp, N. lactamica
atgttgtatttcagatacggttttttggttgtttggtgtgcggcaggtgtttctgccgcctatggggcggatgcgcccgcgattttggatgacaaggcattgttgcaggtgcagcggtcggtgtcggataagtgggcggaatcggattggaaagttgaaaatgatgctccgcgcgtggttgacggggattttttgttggcgcatccgaaaatgttggaacatagtttgcgcgacgcgctcaacggcaatcaggcggatttaatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccgactgaagtcggcagaaaggcattttgcggaggcggcaaaattggatttgccggcgccggttttggaaaatgtggggcgttttcggaaaaaaacggaggggctgacgggctggcgtttttcgggcggtatcagcccggcggtcaatagaaatgccaataatgccgcgccgcagtattgccagcaaaacggaggccggcagatatgcagtgtcagccgggcggagcgagcggcagggttgaattatgaaatcgaggcggaaaaactgacggcgttggcggataatcattatttgttgttccgttccaatatcggcggcacgagctattatttcagtaaaaaatcagcttatgatgacgggttcggcagggcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctatcgcgaacaggatagggcggaatacaataacggtcggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggctgggcgcaggagtggcggcagttgggcggtttgaacagtcgggtttccgcgtcttatgcccgccgcaactataagggcgttgcggctttctcgacagaggcgcaacgcaaccgcgaatggaatgtctcgctggctttgagccacgacaagttgtcgtacaaaggtatcgtaccggcgttgaattatcgtttcggcaggacggaaagtaatgtgccgtatgcgaaacgccgcaacagcgaggtgtttgtgtcggcggattggcggttttga

SEQ ID NO: 372 - protein, 505 aa, N. lactamica
MLYFRYGFLVVWCAAGVSAAYGADAPAILDDKALLQVQRSVSDKWAESDWKVENDAPRVVDGDFLLAHPKMLEHSLRDALNGNQADLIASLADLYAKLPDYDAVLYGRARALLAKLAGRPAEAVARYRELHGENAADERILLDLAAAEFDDFRLKSAERHFAEAAKLDLPAPVLENVGRFRKKTEGLTGWRFSGGISPAVNRNANNAAPQYCQQNGGRQICSVSRAERAAGLNYEIEAEKLTALADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGVAAFSTEAQRNREWNVSLALSHDKLSYKGIVPALNYRFGRTESNVPYAKRRNSEVFVSADWRF

SEQ ID NO: 373 - DNA, 1224 bp, N. lactamica
atgcagattaaccgggcgttgttggcgcgggattgggcggcactgaaacgcctgttggcccaatatgccgaacaaccgcaatatgatgcggtgctgtaccgttatgccctcggcgcgttataccgcagcgagatgcggcagggcgaggcggccgatctataccgtgagttgttgtcagaaaggcctgaccttgtttatccccgttttgatttgggcgtgatgctgtttgaagacaaacaatatcgtgaggcattggttcagttgcaccgggtcgaggaggcgttgcctcccgatatgcggcagcttgcacgggaatatatccgtcaggtggaagcggtgcaggcgtggcatccttcgttcaatatgaattacgaacaaacagataatgtaaacaatgcttccccttcgcgggacatcgtcctcaacggccggaaatggacaagatcagaagacagcctgcccaaacgcgccaacgggataaggtacgaactgggtattgaccggatgtttaacattgcaggcaatcactttgcccgcttaggcatcagcggttccggtgtgcattattggaatgcccgggattttagcgaacaggcgtttcatgccgaaggaggctaccgttatcggaatagccgtctagagtggggattccggccctttgtcgaacaaaaccggctgggcaataaccgttatactgcaaatatgggtattgcgttggattacagtcgccgtctgaatgaaaaatggcgcagcaaccaatctttccagtacggccgcaaacaataccataacgaatatttggcaaaacgttacaacagtaaaacgatttcagtcagcagtacgttcggctattacgctatgccggcttggcagttgtacggaggtattagcggtatgtttgataatactgtggagaaagagcaggcttcacggcgttatggtgtaagtttgggtacggtgaaaatattagacggcggtcttggactgaagttgggtataggttacacgaaacggatatttaaagcccctgcaacattaatttacaattttacccggcgtgatgatgaatatcggatgagtgcggctttatggcataaaaaactgtcgtggaaaggatttacaccccaaataaatttccgttacaacaagatcaacagcaatatgcccgccttttattcgcgcagcggcaaggaatggtttgtcagtatagaaaaaacgtattga

SEQ ID NO: 374 - protein, 500 aa, N. lactamica
MALLGILFEFVMKLMKSKNIFFMGYLIASAVFAEDIGVPVEPINVGSRAAMPSEGESLALLPFAEDVPPVRDAMPSEVPKSAAGGDVRDDRIGMQINRALLARDWAALKRLLAQYAEQPQYDAVLYRYALGALYRSEMRQGEAADLYRELLSERPDLVYPRFDLGVMLFEDKQYREALVQLHRVEEALPPDMRQLAREYIRQVEAVQAWHPSFNMNYEQTDNVNNASPSRDIVLNGRKWTRSEDSLPKRANGIRYELGIDRMFNIAGNHFARLGISGSGVHYWNARDFSEQAFHAEGGYRYRNSRLEWGFRPFVEQNRLGNNRYTANMGIALDYSRRLNEKWRSNQSFQYGRKQYHNEYLAKRYNSKTISVSSTFGYYAMPAWQLYGGISGMFDNTVEKEQASRRYGVSLGTVKILDGGLGLKLGIGYTKRIFKAPATLIYNFTRRDDEYRMSAALWHKKLSWKGFTPQINFRYNKINSNMPAFYSRSGKEWFVSIEKTY

SEQ ID NO: 375 - DNA, 1305 bp, N. lactamica
gtgccgtctgaaacccttgcagccggagaatccgccgaagccgtttcagacggcaatgcctctcttgcgggtttggaagagcagatcaaccgcgccgtcatcgcccgcgattgggatacgctgcaaacgctgctggaaagctatcgcgccctgccggatttcaatccggttctgcacgattacgcgctgggcggtttgcgccgcagccagttgcgccataacgaggcggtggctttgtatcgcggcattttggcgcaacagcccgatttggcgtatccgcgtttcgatttgagcgtaatgctgtttgaaaacaaacagtaccgcgaggcaaaggcagaattggagcgggcgaaacccgatttgcagccgccgatgcagcagcttgccgaccgctatcttgccgccatagacaaggctcaaggctggaagcccgatgtgtcgctgcaatacgagcaaacggacaatgtgaacaacgcttcgtccgaaaaaacgattgaatttgcaggaaaaagctggacaaaaaccgccgacagcctgccgcaaaaggcacacggtttgcgctacggcttgggcgtgtcgcgcgaaatcaatgcgggcgggcatcatttcctctacggcggcatcagcggcggcggcgtgcattattgggataacaaagatttcagcgaacagagcctgcgcctgtcgttcggctataaaaaccgttcggtaacgcgctcgttcggcatcgtgccgtttgtcgagcaaaacctcttaggcggcagccgatacaatttcgtcggcggcttcaatgccgatttctcccaacgcttgagcgaacgctggcggctgacgctgaacgcgggcaatatgtggaagcgttatcaggaagaccgcaccgccgcccgatacgacagccatatgtcgctggtgggcgcgacgctgatgtattccgcgccgaaagactggctgctttacggcggtgcggactggtcgcacgacatgacgaaagaggcggaacaggcttccgtccgcaagggtttgcgtgtcggcgcggtcaaaacgttcgacggcggcctgggtctgcgggcaaacctgcgctatacccgcaggacttttgacgcacccgggaccattgtgtaccgcttcccgcgcaaagaccacgaatatcaggcaaacctgtcgttgtggcacgacaaaatctcttggaagggatttacgccgcaactcaatttccgctatctgaaaatcgacagcaatatgaaaagtttttacacacgcaaaaacatgcagattttcatgagcgtggaaaaggatttcaaataa

SEQ ID NO: 376 - protein, 433 aa, N. lactamica
MPSETLAAGESAEAVSDGNASLAGLEEQINRAVIARDWDTLQTLLESYRALPDFNPVLHDYALGGLRRSQLRHNEAVALYRGILAQQPDLAYPRFDLSVMLFENKQYREAKAELERAKPDLQPPMQQLADRYLAAIDKAQGWKPDVSLQYEQTDNVNNASSEKTIEFAGKSWTKTADSLPQKAHGLRYGLGVSREINAGGHHFLYGGISGGGVHYWDNKDFSEQSLRLSFGYKNRSVTRSFGIVPFVEQNLLGGSRYNFVGGFNADFSQRLSERWRLTLNAGNMWKRYQEDRTAARYDSHMSLVGATLMYSAPKDWLLYGGADWSHDMTKEAEQASVRKGLRVGAVKTFDGGLGLRANLRYTRRTFDAPGTIVYRFPRKDHEYQANLSLWHDKISWKGFTPQLNFRYLKIDSNMKSFYTRKNMQIFMSVEKDF

SEQ ID NO: 377 - DNA, 1515 bp, N. macacae
atgcccgaaagcaccaaaatgcccgatatggtttcgcctcaaataaaaaacgcagattcatgcatcattgcaacccaaacgtcttacgaaatcatgaaaacactcttactcctctccctgctcgccgtgtccgcagcggaagccgccgacgtgccgtccgagcctcaaaaccagcctgcccccgagttgcaggtcaaaacggcagaacctgcccccgtcgaagaagcagcggccaagcctgctgccgaaacgtcgtctgaaaaagtcgtcaacgtcgatgccaaaaccctgctcgacaatccccaattgctttcccgcgccatgtattccgccgttgtttcacgcaacatcgcgggcatcaaagtcgtcctgccgatttacgaacaatggccgggacacgataaaaacatggcactctacgcgcacggattggttgcccaagacgaaggcaaaatgaaagaagccatcgggtattaccgtcaatttatcgccgaaaaccccgatgcccccgtcgtccgctggcagcttgccaccgctttgtttgaagacaagcaaaacgaagccgccgccgaccagttcgacaaactcaaaacagaagccaacctgcccgagccgctcgtcaaaggcatcgaatcctaccgcaaagcattgcgcgagcgcgattcgtggaaattcaatgccggcttgagcgttacccgcgaacaaaacatcaaccaagcccccagccgccgcacatacggcaactggaccttccccgagcctatcgacgccaccgccatcaactaccaactcggcgcagagaaaaaatggtcgctgcccaaaggctggtacgttacggcaggcgcggacaattacggcaaaatttatcccgaacaaaccaagtataacgacgtaaccacccgcttttcagtaggcgcaggctacgccgaccaacgcaacgacatcggcttgaccccgttccacgaacgccgcttctacggcaacgacccgtatacctactccagcggtgcgcgcctgcacatcaaccgctggtggcagcctaagctgcaaaccttgagtgccgttgaaatgggtcgtctgaaaaacacccgccgcgccaaatccgacagcaacaaccgcctgttgagcaattccgtcgtctattaccgaaacgcccgccaatactgggtcggcggtttcgacatctatcaggaacgcaataaagaagacaaatcggacagcttcgaccgttacagcctccgtaccgcatgggggcaggaatggggcaaagggctgtcgactatgttgcggctgagtgcggcacaacgccgttatcaaacgcccagccttttgagcggtcaggaaaaccgccgcgataaagaagcggatatttcgctcgccgtgtggcaccgcgctttccacttcaaaggcatcaccccgcgcctgaccgttgcccaccacaaaacatggagcaacgacaaatactacgaatacggcaaaaccagaatgtttgtcgaattcagcaaaacgttctga

SEQ ID NO: 378 - protein, 504 aa, N. macacae
MPESTKMPDMVSPQIKNADSCIIATQTSYEIMKTLLLLSLLAVSAAEAADVPSEPQNQPAPELQVKTAEPAPVEEAAAKPAAETSSEKVVNVDAKTLLDNPQLLSRAMYSAVVSRNIAGIKVVLPIYEQWPGHDKNMALYAHGLVAQDEGKMKEAIGYYRQFIAENPDAPVVRWQLATALFEDKQNEAAADQFDKLKTEANLPEPLVKGIESYRKALRERDSWKFNAGLSVTREQNINQAPSRRTYGNWTFPEPIDATAINYQLGAEKKWSLPKGWYVTAGADNYGKIYPEQTKYNDVTTRFSVGAGYADQRNDIGLTPFHERRFYGNDPYTYSSGARLHINRWWQPKLQTLSAVEMGRLKNTRRAKSDSNNRLLSNSVVYYRNARQYWVGGFDIYQERNKEDKSDSFDRYSLRTAWGQEWGKGLSTMLRLSAAQRRYQTPSLLSGQENRRDKEADISLAVWHRAFHFKGITPRLTVAHHKTWSNDKYYEYGKTRMFVEFSKTF

SEQ ID NO: 379 - DNA, 1440 bp, N. macacae
atgtacaaaccgtctgcctgccttatcctgtttcttgccgcccccgtccttgccgcgccccgttctgacttttcagacgaccgtaccgcgcaacgtctgtggcaggacacccgccaaaccatgcaggaacaggaacaaaaagtgcgcgaataccgcctcgacattcccgccgaacacatcgggcagacagccgaaaccgaccccgaagccgaccaaggcgaagccctgtttaacgccgtcaaccgcagcgactggcaaaccgtgcgcccgctgcttgagcgttatacccagcaaaccgaatacgaccccgacatcgccctctttgcccgcgcctcgctcgcccgcggcgaaggcagatggaaagccgccaaacaagactacgaaaccctgctgcaacgccatcccgacttcacgcgcggacggctcgattacgcccgcctgctctttgaaggtcgtctgaaccgcgaagccacttccgaatttatgcgcctgcaaaacgaagacctgcccgaagccgtcaaagaaaacatcggccattttcgcgactctctaaaccaacgccaaagctggcagggcagcctttccgtcggcgccgtctacaacagcaacatcaacgaagccagcggcaaagtgtggtgtaaaaccgaaatcgacggcgaatgctgggaagaattttcaggcgaccaacccatttccgccaacggcatcaaatacgaagccgccgccgtccgccgctggcagattaaaggacaccacggcatcgccgcccgcgcgctcggctacggacgtttctaccacgaccataaagacttcaacgaacacacgctcaacctcagcgcaggctaccagtttgaaaaccaccgccacaccttcgccctcgccccgctcgtcgaatggaacggcagcggcggcaaaaccctcaaccgcgcctacggcgtgcgcagcgagtggaacctcgacaaaggcagttggacgtggaacaccgaagccgagtggaaacacctctcctattccgacaaaacccgcctgctcgacggcagcctcttctccgtttacaacaccctgtcctacttcccgcgcaacgacctcatgctctacggcggcatagactggcagcagcgcaaagccaaagagccggtggacagctaccgcctcatctccgcacggctgggcgcggcaaaaatgtttgaagccggtttcgacgcctccgcctccgccaccttcggcatccgcagccaccgcgaagaaaacgccgtactcgaacaacgccgccgcgacaaagaacagacctaccgcctcagcataggcgcggaccgctggaaattcgccggcatgaagcccgtcctcagctacaaacaccgccgcgtccacggcaacaccgactggctgtacagctataagcaaaacgaagtcggtctgtcgctggtcaaatcgttctaa

SEQ ID NO: 380 - protein, 479 aa, N. macacae
MYKPSACLILFLAAPVLAAPRSDFSDDRTAQRLWQDTRQTMQEQEQKVREYRLDIPAEHIGQTAETDPEADQGEALFNAVNRSDWQTVRPLLERYTQQTEYDPDIALFARASLARGEGRWKAAKQDYETLLQRHPDFTRGRLDYARLLFEGRLNREATSEFMRLQNEDLPEAVKENIGHFRDSLNQRQSWQGSLSVGAVYNSNINEASGKVWCKTEIDGECWEEFSGDQPISANGIKYEAAAVRRWQIKGHHGIAARALGYGRFYHDHKDFNEHTLNLSAGYQFENHRHTFALAPLVEWNGSGGKTLNRAYGVRSEWNLDKGSWTWNTEAEWKHLSYSDKTRLLDGSLFSVYNTLSYFPRNDLMLYGGIDWQQRKAKEPVDSYRLISARLGAAKMFEAGFDASASATFGIRSHREENAVLEQRRRDKEQTYRLSIGADRWKFAGMKPVLSYKHRRVHGNTDWLYSYKQNEVGLSLVKSF

SEQ ID NO: 381 - DNA, 1467 bp, N. macacae
atgaaacgcctgctcatcctgcccgtttttctgagcctgctgccccacgcgtttgccgacgacagggaagaccgcttcatgcagctcaaacagggaacggaactccgccgcgcgcagcaggaaaggaacgaagcggacaatacggcgattgagttcggcgcgggagaagtgcaggacggcgaagatttggcgttgtcgctgatgaaggcggtcaacgcgcaaaacgaagaggaaacggcgcggctgttggacatttaccgccgtcaggatgattccgaccccgatatagtgctgtttgccgaggccaatcaggcggtgttccgcgacgatttgaaggccgcgctggcgaaataccgcgagctttaccgtaaaaatcccgaatttctgcgcggccgcctggatttggcgcggctgctgtttatagacaaacaaaacaaagaatcggcggcattgttcgacggcatcgatattcctgaagtgcccgccgtcaatgagaaaatcaaagtgtttgccgacgctttgaagaaacgcgatgcgtggagcggttcggtttcgttcggcgcgggttacgacaccaacttaaaccaatcgtcgggcgcgacggttgtccgcaatcagacaagctgcggtttcgattcgaacgggcaaccgattctggacggcgacggaatgctgtcctgccgcaacgaacggcttgacgcctacgcgcccgatgcgttgaaaaaccggatgtgggtatatgaagccaacttaagcagacgcatttcgctcaacggccaccacggcctgcaactgggcggctacgcatggggccggctctatcccggcaacaaggaatacggcgaacacaatatcaacgtcagccccgcttacagttttcagagcaaagaccattccttcagtatcggcccgcaggtgcaatacgaatggtcgggcggcaaactgcgcgacagcagcgccggcatcagcacggcatacagccgcaccttttccgaccaagcctcgctgggcgtgcagcttgatcacaaatacgaccgctaccgcggcgaattaaaacatttcaacggcccgcagacgcttctgttcaccaccgccatctacgccctgccgaaagactggctggtattcggcggctacgactacctgcgcaaaaacagccgcgaaaaagtggattcctaccgccggcacggcctgcgcgcgggtgtcaacaaacgtttcgaatccggcatcgacgccacctttcaggcaatctggcgtaaaacagcatatcaggactaccatgcctggctggaaacccgccgccatgattccgaacgcacctatcagttggacatcaaatttgaccgtccgtccttccgcggcatcacgcccgttttcagcatcaaacacaccgacaacaaaagctcgtcctggctgaaccgctacaaacgcaacgaatttaccgtcaaagcagaatacaagttttaa

SEQ ID NO: 382 - protein, 488 aa, N. macacae
MKRLLILPVFLSLLPHAFADDREDRFMQLKQGTELRRAQQERNEADNTAIEFGAGEVQDGEDLALSLMKAVNAQNEEETARLLDIYRRQDDSDPDIVLFAEANQAVFRDDLKAALAKYRELYRKNPEFLRGRLDLARLLFIDKQNKESAALFDGIDIPEVPAVNEKIKVFADALKKRDAWSGSVSFGAGYDTNLNQSSGATVVRNQTSCGFDSNGQPILDGDGMLSCRNERLDAYAPDALKNRMWVYEANLSRRISLNGHHGLQLGGYAWGRLYPGNKEYGEHNINVSPAYSFQSKDHSFSIGPQVQYEWSGGKLRDSSAGISTAYSRTFSDQASLGVQLDHKYDRYRGELKHFNGPQTLLFTTAIYALPKDWLVFGGYDYLRKNSREKVDSYRRHGLRAGVNKRFESGIDATFQAIWRKTAYQDYHAWLETRRHDSERTYQLDIKFDRPSFRGITPVFSIKHTDNKSSSWLNRYKRNEFTVKAEYKF

SEQ ID NO: 383 - DNA, 1476 bp, N. macacae
atgaacaaatcctgcctcctcctgctcgccctgctgcccctgtccgcccacgcagacagcgacgacttgcgccgcctgtctgaagaaaacgggcgcgtgcagcagcaatatcgggaaagcggctggctggacgacggcacacccgcaggcgatatcgaaaacgacgacgcatacatccgcatcggcggtcagatttacaccgtaggcaacaataccgaagagctggaaagcgcgatttatcatgccattaacgaacatcaatggaaaaaggctgaacgcttcgccacgcgctacgccgccctgcccggccacaatcccgccctgcccaaattggtactcggtttgaaacaacgcgccgaaggacgcctcgccgaagccttacggaacctgcaagcagcagaagcactcgaccccgccaacccgcgcatcctgctcgaaaccgcgcgcctttataccgaagacaaccaaaaccgcgaagcccgaagcgcattcgtccgcgcccaaaccgccgacattcccgaagaaacccgcgccctgatcggacaatacctcggcgaaatcgacaaacgcagccgctggcacggacaaatcggcatcgcttacggctacaacagcaacatcaaccaatccgacggctccgtccgctgcatcctgccgcttgacggccaatgcctcgcctaccaaaacctgcccgaccccatccgttcccccgtatggaattacagcctgagcgcaggcaaaatcacccccgtcaaaggacaccacagcctcaaaaccaacctcctcgcctacggcacgcactaccgccgcaaagacacagacgccgccttgtccgactacggcagccaaaccggcacactgtctgccggttacgaatacgccgacgcccaaagccgcctatcgctgatgcccgtttacgaacacgaacggcgcaaccgccacacctactacaacgcctacggcgccgaagcctcgtggacgcataccatcaacccaaaatggcaggtcaacgccgactggtcgggcaaacgctaccgccacagcggcaccgcgaaaacctacgccgccgactacaccgaataccgcacaggcttaggcgcagaatacgccctgaccccgaaaaccggcgtgttcgcaggctccgactacacccgccgcacatacaacggcggcacatccgaccaccgcgaatacaccctccgcacaggcttatacaccctgtttgacaacggcacctacctcaacgccctcgtcatgaaacggcgcaacctctacgaccgcgcaggcatcgccgcagacggacaaagacgcagcgaccgccaaaccgtctggctcgccgccgcaggcttcagacaatggcacatcggcggcttctaccccgaactgcgcttcaaacacaccaccgtcaaaagcaattccgtgttctaccgctaccgccaaaacgaaatcatgttgggcgtgaagaaacagttttga

SEQ ID NO: 384 - protein, 491 aa, N. macacae
MNKSCLLLLALLPLSAHADSDDLRRLSEENGRVQQQYRESGWLDDGTPAGDIENDDAYIRIGGQIYTVGNNTEELESAIYHAINEHQWKKAERFATRYAALPGHNPALPKLVLGLKQRAEGRLAEALRNLQAAEALDPANPRILLETARLYTEDNQNREARSAFVRAQTADIPEETRALIGQYLGEIDKRSRWHGQIGIAYGYNSNINQSDGSVRCILPLDGQCLAYQNLPDPIRSPVWNYSLSAGKITPVKGHHSLKTNLLAYGTHYRRKDTDAALSDYGSQTGTLSAGYEYADAQSRLSLMPVYEHERRNRHTYYNAYGAEASWTHTINPKWQVNADWSGKRYRHSGTAKTYAADYTEYRTGLGAEYALTPKTGVFAGSDYTRRTYNGGTSDHREYTLRTGLYTLFDNGTYLNALVMKRRNLYDRAGIAADGQRRSDRQTVWLAAAGFRQWHIGGFYPELRFKHTTVKSNSVFYRYRQNEIMLGVKKQF

SEQ ID NO: 385 - DNA, 1467 bp, N. meningitidis
atggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 386 - protein, 488 aa, N. meningitidis
MVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIAAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 387 - DNA, 1518 bp, N. meningitidis
atgttgtatttcagatacggctttttggttgtttggtgtgcggcaggtgtttctgccgcctatggggcggatgcgcccgcgattttggatgacaaggcattgttgcaggtgcagcggtcggtgtcggataagtgggcggaatcagattggaaagttgaaaatgatgccccgcgcgtggttgacggggattttttgttggcgcatccgaaaatgttggaacatagtttgcgcgacgcgctcaacggcaatcaggcggatttaatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgcggaggcggcaaaattggatttgccggcaccggttttggaaaatgtggggcgttttcggaaaaaaacggaggggctgacgggctggcgtttttcgggcggcatcagtccggcggtcaatagaaatgccaataatgccgcgccgcaatattgccggcaaaacggaggccggcagatatgcagtgtcagccgggcggagcgggcggcagggttgaattatgaaatcgaggcggaaaagctgacgccgttggcagataatcattatttgttgttccgttccaatatcggcggcacgagctattatttcagtaaaaaatcagcttatgatgacgggttcggcagggcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctaccgcgaacaggatagggcggaatacaataacggcaggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggttgggcgcaggagtggcggcagttgggcggtttgaacagtcgggtttccgcgtcttatgcccgccgcaactataagggcattgcggctttctcgacagaggcgcaacgcaaccgcgaatggaatgtctcgctggctttgagccacgacaagttgtcgtacaaaggtatcgtgccggcgttgaattatcgtttcggcaggacggaaagtaatgtgccgtatgcgaaacgccgcaacagcgaggtgtttgtgtcggcggattggcggttttga

SEQ ID NO: 388 - protein, 505 aa, N. meningitidis
MLYFRYGFLVVWCAAGVSAAYGADAPAILDDKALLQVQRSVSDKWAESDWKVENDAPRVVDGDFLLAHPKMLEHSLRDALNGNQADLIASLADLYAKLPDYDAVLYGRARALLAKLAGRPAEAVARYRELHGENAADERILLDLAAAEFDDFRLKSAERHFAEAAKLDLPAPVLENVGRFRKKTEGLTGWRFSGGISPAVNRNANNAAPQYCRQNGGRQICSVSRAERAAGLNYEIEAEKLTPLADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGIAAFSTEAQRNREWNVSLALSHDKLSYKGIVPALNYRFGRTESNVPYAKRRNSEVFVSADWRF

SEQ ID NO: 389 - DNA, 1422 bp, N. mucosa
atgaaaacactcttactcctctccctgctcgccatgtccgcagcagaagccgtcgacgtgtcgtccgagactcaaaaccagcctgctcccgagttgcaggtcaaaacggcagaaccagaccctgttgaagaagaaacggtcaaacctgccgccgagacgtcgtctgaaaaagttgtcaacgtcgatgccaaaaccctgctcgacaatccccaattactttcccgtgccatgtattccgccgttgtttcgcgcaatatcgcgggcatcaaggttgtcctgccgatttacgaacaatggcagggacacgataaaaacatggcgctctacgcacgcggattggttgcccaaaacgacggcaaaatgaaagaagccatcgggtattaccgtcaatttatcgccgaaacccccgatgcccccgtcgtccgctggcagcttgcaaccgctttgtttgaagacaagcaaaacgaagccgccgccgaccagttcgacaagctcaaaacagaacccaatctgcccgagccgttcgtcaaaggcatcgagtcttaccgcaaagcattgcgcgagcgcgattcgtggaaattcaacgccggcttgagcgtgacccgcgaacaaaatatcaaccaagcccccagccgccgcacatacggcaactggactttccccgagcctatcgacgctaccgccatcaactaccaactcggcgcagagaaaaaatggtcgctgcccaaaggctggtacgccacggcaggcgcggataattacggcaaaatttatcctgaacgcaccaagtataacgacgtgaccacccgcttctcagtgggcgcaggctacgccgaccagcgcaacgacatcggcttgaccccgttccacgaacgccgcttctacggcaacgacccgtacacctactctagcggcgcgcgcctgcacatcaaccgctggtggcagcccaagctgcaaaccctgagcgccgttgaaatgggtcgtctgaaaaacacccgccgcgcccgttccaataataacaaccgccttctgagcaattccgtcgtctattaccgaaacgcccgccaatactgggtcggtggcttcgatatttatcaggaacgcaataaagaagataagaccgacaacttcgaccgttacagccttcgtaccgcatgggggcaggagtggggcaaaggattgtccaccatgttgcggctgagtgcggcgcaacgccattatcaaacgcctagtcttttgagcggtcaggaaaaccgtcgcgataaagaagcggatatttcgctcgccgtgtggcaccgcgctttccatttcaaaggcatcaccccgcgcctgaccgtcgcccatcacaaaacatggagcaacgacaaatataatgaatacggcaaaaccagaatgtttgtcgagttcagcaaaacgttctga

SEQ ID NO: 390 - protein, 473 aa, N. mucosa
MKTLLLLSLLAMSAAEAVDVSSETQNQPAPELQVKTAEPDPVEEETVKPAAETSSEKVVNVDAKTLLDNPQLLSRAMYSAVVSRNIAGIKVVLPIYEQWQGHDKNMALYARGLVAQNDGKMKEAIGYYRQFIAETPDAPVVRWQLATALFEDKQNEAAADQFDKLKTEPNLPEPFVKGIESYRKALRERDSWKFNAGLSVTREQNINQAPSRRTYGNWTFPEPIDATAINYQLGAEKKWSLPKGWYATAGADNYGKIYPERTKYNDVTTRFSVGAGYADQRNDIGLTPFHERRFYGNDPYTYSSGARLHINRWWQPKLQTLSAVEMGRLKNTRRARSNNNNRLLSNSVVYYRNARQYWVGGFDIYQERNKEDKTDNFDRYSLRTAWGQEWGKGLSTMLRLSAAQRHYQTPSLLSGQENRRDKEADISLAVWHRAFHFKGITPRLTVAHHKTWSNDKYNEYGKTRMFVEFSKTF

SEQ ID NO: 391 - DNA, 1440 bp, N. mucosa
atgtacaaaccgtctgcctgccttatcctctttctcgccgcgcccgtccttgccgcgccccgttctgacttttcagacgaccgtaccgcgcaacgcctgtggcaggacacccgccaaaccatgcaggaacaggaacaaaaagtgcgcgaataccgcctcgacattccctccgaaaacatcgggcagacagccgaaaccgatcccgaagccgaccaaggcgaagccctgttcaacgccgtcaaccacagcgactggcagaccgtgcgtccgctgctcgagcgttatacacagcaaaccgaatacgaccccgacatcgccctctttgcccgcgcctcgctcgcccgcggcgaaggcaggtggaaagccgccaaacaagactacgaaaccctgctgcaacgccatcccgacttcacgcgcggacggctcgattacacccgcctgctctttgaaggtcgtctgaaccgcgaagccacttccgaatttatgcgccttcaaaacgaagacctgcccgaagccgtcaaagaaaacatcggacatttccgcgactctctaaaccaacgccaaagctggcagggtagcctttccgtcggcgccgtccacaacagcaacatcaacgaagccagcggcaaaacgtggtgtaaaaccgaaatcgacggcgaatgctgggaagaattttcaggcgacaaacccatttccgccaacggcatcaaatacgaagccgccgccgtccgccgctggcagattaagggacaccacggcatcgccgcccgcgcgctcggctacggccgcttctaccgcgaccataaagacttcaacgaacacacgctcaacctcagcgcaggttatcagtttgaaaaccaccgccacaccttcgcccttgccccgctcgtcgaatggaacggcagcggcggcaaaaccctcaaccgcgcctacggcgtgcgcagcgagtggaacctcgacaaaggcagctggacttggaacaccgaagccgagtggaaacacctctcctattccgacaaaacccgcctgcttgacggcaacctcatctccgtttacaacaccctgtcctacttcccgcgcaacgacctcatgctctacggcggcatagactggcagcagcgcaaagccaaagaaccggtggacagctaccgcctcatctccgcacggctgggcgcggcaaaaatgtttgaagccggcttcgatgcctccgcctccgccaccttcggcatccgcagccaccgcgaagaaaacgccgtactcgaacaacgccgccgcgacaaagagcaaacctaccgcctcagcataggcgcggaccgctggaaattcgccggcctcaagcccgtcctcagttacaaacaccgccgcgtccacggcaacaccgactggctgtacagctacaaacaaaacgaagtcggtctgtcgctggtcaaatcgttctaa

SEQ ID NO: 392 - protein, 479 aa, N. mucosa
MYKPSACLILFLAAPVLAAPRSDFSDDRTAQRLWQDTRQTMQEQEQKVREYRLDIPSENIGQTAETDPEADQGEALFNAVNHSDWQTVRPLLERYTQQTEYDPDIALFARASLARGEGRWKAAKQDYETLLQRHPDFTRGRLDYTRLLFEGRLNREATSEFMRLQNEDLPEAVKENIGHFRDSLNQRQSWQGSLSVGAVHNSNINEASGKTWCKTEIDGECWEEFSGDKPISANGIKYEAAAVRRWQIKGHHGIAARALGYGRFYRDHKDFNEHTLNLSAGYQFENHRHTFALAPLVEWNGSGGKTLNRAYGVRSEWNLDKGSWTWNTEAEWKHLSYSDKTRLLDGNLISVYNTLSYFPRNDLMLYGGIDWQQRKAKEPVDSYRLISARLGAAKMFEAGFDASASATFGIRSHREENAVLEQRRRDKEQTYRLSIGADRWKFAGLKPVLSYKHRRVHGNTDWLYSYKQNEVGLSLVKSF

SEQ ID NO: 393 - DNA, 1422 bp, N. mucosa
atgaataaaaatcacctagtcttactgatgctctctttcccaatagccgcccttgccgatacacccgttgtccgtgtacctgcgcctgtattttttgacaagcaaccgaacagcgatacaccctcaaaagattttaccgacgacaaacctgcagaacagaggctttcagacgacctttctgccgattcctcattggaagcacagatcaaccgcgcattaatcggacgggactggaagacgctggaaggcttgttggcgcaatataaagccgcgcccgaccgggatgccgttttatacgattatgctttaggcgccttgcggcgcagtcagttgcggcatggtgaggctgtatcgctctatcgcggcattttggcgaaacatccggatttggcgtatccgcgtttcgatttgggcgtaatgatgtttgaaaacaaacagtaccatgaggcaaaagctgaattgaaacgggcaaaaccggatttgcagccgcccatgcagcaacttgccgaccgctatcttgcttccattgaatcggcgcaaagctggcagcccgatgtttcactgcaatacgagcagaccgataatgtgaacaatgcctcatccgagcacgttatagaatggaacggcagacgctggaataaaaccgctgagagcctgccgcaaaaggcacatggtatccgctatggcgcaggcgtatcgcgcgaaattaatgcgggtgggcatcatttcgtttacggcagcctgagcggcgacggtgtatattattgggataatcaggattttaacgagcaaagcctacgcttggcggcgggttataaaaaccgttcggcggtgcaatctttcggggttgtaccgtttgccgagcaaaactggctgggtggcaaacgctataatcgcgaaaccggtatccataccgatttttcacgtcgtctgaacgaaaaatggcggctctcgctcaatgcaggctatatcaaaaaatactatcggaacagcgattcggcagcgcgttacaacagccatatgccgctggcgggggcaacgctagcatactctgcgccgaaaaactggctgctctacggcggcgcagactggtcgcacgacatgaccaaagaagcggagcaggcatctgtgcgcaagggcatacgcttcggcgcggcgaaagcgtttgagaacggattcggcatccgcaccaacctgcgctacgcccgccgtacctttgatgcgccgggaagcctggtgtaccgtctgacccgtaaagaccatgaatatcaagcaaatgcctctatttggcacaataaaatttcatggaaaggcttggtgccgcatttgaatttccgttatctgaaaatcgacagcaatatgagcggcttctattcccgcaagagtatgcagacattcgtcagcgtggagaaacagttttga

SEQ ID NO: 394 - protein, 473 aa, N. mucosa
MNKNHLVLLMLSFPIAALADTPVVRVPAPVFFDKQPNSDTPSKDFTDDKPAEQRLSDDLSADSSLEAQINRALIGRDWKTLEGLLAQYKAAPDRDAVLYDYALGALRRSQLRHGEAVSLYRGILAKHPDLAYPRFDLGVMMFENKQYHEAKAELKRAKPDLQPPMQQLADRYLASIESAQSWQPDVSLQYEQTDNVNNASSEHVIEWNGRRWNKTAESLPQKAHGIRYGAGVSREINAGGHHFVYGSLSGDGVYYWDNQDFNEQSLRLAAGYKNRSAVQSFGVVPFAEQNWLGGKRYNRETGIHTDFSRRLNEKWRLSLNAGYIKKYYRNSDSAARYNSHMPLAGATLAYSAPKNWLLYGGADWSHDMTKEAEQASVRKGIRFGAAKAFENGFGIRTNLRYARRTFDAPGSLVYRLTRKDHEYQANASIWHNKISWKGLVPHLNFRYLKIDSNMSGFYSRKSMQTFVSVEKQF

SEQ ID NO: 395 - DNA, 1542 bp, N. mucosa
atgttaagaataaaacaaaaaatggtttcggcatctttatgttgcctgttgccttccgcagtcttggctgaattgcccgaaggtggtgtccggcaggatgcaccttctcaggatgctgccgtacaagtgcagcaaaaacaatggctggatattttgtccgaagaagaaaggtcgtctgaaaagaatgagaatgtcggcgaaccggctgtagtcggcgatgattttttagcggcaaacccgcgtattcttgaggacgcgctgattcaagcacttaacggcaatagcgcagatttggtttcttcgcttgccgcactttaccgtaaacagcccaaccacaatcccaagctgattgcacgtgccgatgctttactggcaaagttgaaagggcggacttccgaagcggtcgaacgttatcgtaccctttatgaatccgacgtttcagacgaccgcatattgttggatttggcggcggcagagtttcaggattatcgtttgggcgaggcggcggcgcatttccgccatgccgcgcaacgcgatatacctgcccccgttttggaaaacgtcaaacgttttcaagaagctgtcaagcggcagacagaatggaaatggtctggtggaatcagtcccgtacatagcgataacgccaacaacgctgctccgcgttattgcatcgaaacaagggggcaaaccgcatgcagcgttactgtgcccgtcagtgccaacggcttgaattacgaattgaacaccgaaaaactcaccccgctgtacgggcatcacgccgtcaaattccgcgccaacctcagcggaacgagctattttttcgaccaccaatcggcttacgacgatgcgttcggcagggcttatttgggctggcagcgcaaggacggtaaacaaaccgtcagcgttttaccgttttatcaggcacagttggcaggcagcagcgagtttgacagcaaaaaagaaaacaaccgccgtgccgcgccttatatgctggcacacgggattggcgtacagctttcgcatatggtcaatctcggcaacgcgacacaactttattactcgctggaacgctatcgccaaaactatcgggaaactgatcgtgcgctgcgcaacgacggttggcacgacagtacctatctctccctagcgcgccgtttcggcagaacgaccctgttcggtggttggcaatacaaccgctttgttcctgaaaacaaaaacatacgcaatgccgtcaacaatgccgcctaccgccgcagcgggttcaatataggctggatacagcaatggccgtttttgggcgggctgaacagccgcctgaccgcttcatttgccaaccgccgctataaaggcattatggcattcggtacagagtcgcaacgtaaccgcgagcactcactctccgtcagccttagtcatgacaaattgtcctacaaaggtatcacgccgaccttgaattacggatacagccgtatccgcagcaatgccccttatgcacgacgcagcagccgtcaatggtcgttgggagctgaatggaatttttaa

SEQ ID NO: 396 - protein, 513 aa, N. mucosa
MLRIKQKMVSASLCCLLPSAVLAELPEGGVRQDAPSQDAAVQVQQKQWLDILSEEERSSEKNENVGEPAVVGDDFLAANPRILEDALIQALNGNSADLVSSLAALYRKQPNHNPKLIARADALLAKLKGRTSEAVERYRTLYESDVSDDRILLDLAAAEFQDYRLGEAAAHFRHAAQRDIPAPVLENVKRFQEAVKRQTEWKWSGGISPVHSDNANNAAPRYCIETRGQTACSVTVPVSANGLNYELNTEKLTPLYGHHAVKFRANLSGTSYFFDHQSAYDDAFGRAYLGWQRKDGKQTVSVLPFYQAQLAGSSEFDSKKENNRRAAPYMLAHGIGVQLSHMVNLGNATQLYYSLERYRQNYRETDRALRNDGWHDSTYLSLARRFGRTTLFGGWQYNRFVPENKNIRNAVNNAAYRRSGFNIGWIQQWPFLGGLNSRLTASFANRRYKGIMAFGTESQRNREHSLSVSLSHDKLSYKGITPTLNYGYSRIRSNAPYARRSSRQWSLGAEWNF

SEQ ID NO: 397 - DNA, 1335 bp, N. nitrogenifigens
gtgccggtgctgatccttgctctggcgccgacgctcatggccgtttcgacgcccgcgctccccccgttcacgccaccctccccgacgaccgggacgcttcagctttcacctgtgcagatgttcgattttgccgaggcggcgtcaaaacgaggtgactatgacaccgccgaacgagccctgcgtgcactgatcggcaatccgggcatcgacatccgttgcgaggcgcgctttcgtctcgctcgcctgctcgccggtcccttccatcgtcggaccgaagcggctttgctcttgcgacggatacttgatgaaaagcccaatgccgcaccggtgcggctcgaactggcacgcctcgaagctgaaatgggccggaccggcgcggccgggcgcgaattgcgcgccgcgcaagcgatcggccttcccgccgacatcgcccgcatggtgcgtttctatcaacaggcgctcgaggcgcagcgccccatgagcggcagcatcgaactcgcgctggcccccgacagcaacgtcaatcgcgcgaccacggcgtcaaccatgggcaccgtcattggcgatttcacgctcagccgggacgcgcgcgcaacttcgggcatggggctggtcgtccggacacaggcgttcgcacgactgcggatgacgccgcgcctgtccctgctcgcgcgcctgtccggcagcgccagtctctatcgcgaccccggtttcgacgacgaagtggtcgccccgcagatcggccccgaatggagcctgggcgacgatcgcgtcagcctgagcggtggcgcggcactgcgctggtacggcgggcgaagttataccaccgccacgactgccgcgatcgactggcaacatcggctgggcaagcgcgggctgctgcgggtgagcgccaaccacgcctttgtcgacaatcaccgcaacgctctggaaaccggttcggcctggggcggcacggcaggtctcgaccgcgcgttctcggcccgctttggcgggggtctttcgctcttcggcaatcgccaggatacccgcgatcccggctatgccacgaccagcttcggcttcagcccctatgtctttcgcgaaataggccgggcgaccgtgacggctacgctgtcctacagccaccttgccgccgatgcccgcattgccttgttcaacgatcgccgacgcgatcaggcctatggcctgaaccttgccgcgacattgcgccaaattcgcatcggttccttgtcaccgctcctgcgtttgcggctagaacggaacgcatcaaccgtccaactctatgattataaaagagtcgccggagaagtgggaatagcctccgcattctga

SEQ ID NO: 398 - protein, 444 aa, N. nitrogenifigens
MPVLILALAPTLMAVSTPALPPFTPPSPTTGTLQLSPVQMFDFAEAASKRGDYDTAERALRALIGNPGIDIRCEARFRLARLLAGPFHRRTEAALLLRRILDEKPNAAPVRLELARLEAEMGRTGAAGRELRAAQAIGLPADIARMVRFYQQALEAQRPMSGSIELALAPDSNVNRATTASTMGTVIGDFTLSRDARATSGMGLVVRTQAFARLRMTPRLSLLARLSGSASLYRDPGFDDEVVAPQIGPEWSLGDDRVSLSGGAALRWYGGRSYTTATTAAIDWQHRLGKRGLLRVSANHAFVDNHRNALETGSAWGGTAGLDRAFSARFGGGLSLFGNRQDTRDPGYATTSFGFSPYVFREIGRATVTATLSYSHLAADARIALFNDRRRDQAYGLNLAATLRQIRIGSLSPLLRLRLERNASTVQLYDYKRVAGEVGIASAF

SEQ ID NO: 399 - DNA, 1341 bp, N. pentaromativorans
atgtttggcccggttctggtctatgcggcaacactggcggccccggcaacgtcggcagccgcacatgatggcaattcgaacggtcctgaacttcgggagaccaggctcgaacacctttctgccgacgatgtgctggcgctggccggaaaactgatcgacgcgggccggtacgaggaagcgcaagtcttgctggaccggctggcggcggacggtgcgggaggcgtcgagcgcgcctttcttgatggaatgctggcacttgcgcgcaaggattacccgcaggctgaacgattgctccgcaagatactcgaaggcgaccccagcctggttcgggtgaggcttgaacttgcccggaccctctttctcgcaaagaaggacgagcaggccgactaccagttccgcctcgccatcgccgagcacccgcccgagacggtgattgccaatatcgcccgcttccgcgaagcaatccgtgcgcggcgggcttggcgcttcaatgtcaacatcgggatcgcgccggacaccaacatcaactcggccaccaacaaggagcaggtcgatatcttcggcttgccattcaagcttgacgacaatgcgagggcgcgttcggggatcggcatggtcgcaggtggtgatgcatcggtgcgtctgtggcgcttcagcaaggtaccggtctatctcggcgcctatggccgtgtccttcgctacaaggaccatgacttcgacgacatctatgtcggcggggaggctggccccgagtttcgcctttcgggcgggcgtctcagagccacggccactgctttccagcgctggtacggaggcaaggacctcgtcaccagtcttggcggcaggctcaattacgacaaggtgatcggcggcaagttgggtattgatgccagccttgcctttcgccgcgacaactatgcccggcgccgcgatctggatgcttgggctatcgaggcgaccctctccgccaacagggcgatatcactatctgcgataggcttcgcctataccactgtccggcgcagcattgctcacgagccgggctattcgaactggaacgcgaggattggcggcggcgtgctcaaggagatcggctggggcctgcgcccgcaactgggcatcgaggtcggccgacagatcaacgacgagaggctcggggtcttcggcaggacgcgccgcgactggtcgctgcaggccagcgccagcatctacaagcgcgactggaacattgccggcttcgccccatccgtcaaagtcacatggagccgcacctactccaccattgccttctatgaccagaagcgcctgcgcacagagttcgggctcaccaaggcattctga

SEQ ID NO: 400 - protein, 446 aa, N. pentaromativorans
MFGPVLVYAATLAAPATSAAAHDGNSNGPELRETRLEHLSADDVLALAGKLIDAGRYEEAQVLLDRLAADGAGGVERAFLDGMLALARKDYPQAERLLRKILEGDPSLVRVRLELARTLFLAKKDEQADYQFRLAIAEHPPETVIANIARFREAIRARRAWRFNVNIGIAPDTNINSATNKEQVDIFGLPFKLDDNARARSGIGMVAGGDASVRLWRFSKVPVYLGAYGRVLRYKDHDFDDIYVGGEAGPEFRLSGGRLRATATAFQRWYGGKDLVTSLGGRLNYDKVIGGKLGIDASLAFRRDNYARRRDLDAWAIEATLSANRAISLSAIGFAYTTVRRSIAHEPGYSNWNARIGGGVLKEIGWGLRPQLGIEVGRQINDERLGVFGRTRRDWSLQASASIYKRDWNIAGFAPSVKVTWSRTYSTIAFYDQKRLRTEFGLTKAF

SEQ ID NO: 401 - DNA, 1305 bp, N. pentaromativorans
atggccagcagcgaagccgccgccaatgagcctgcgcctgtcgccatgaacgcgcggccctcgaccgatgcagaagacgcaccggtcgtcggccttgaagcccttgtcgaacaattgcttcgggagggtcggaccgaggaggccgcaagcatcctggaacaatttgcaaaggacgatctccacaaggtccgcatgcagttcctgaaaggcatggtcgcgcttacccgccgcgattaccgcgaagcgatcaaccggttccgcgtgatcctgatcgatcatcccgacgctgttcgcgtgcgcctcgaattggcgcgcgccttcttcatggacaaggattacgccaatgccgacagacagttcagactgactcgcgccgggaagctgccccgcgacgttctcgccaatatcgacgcctatctcttcgcgatccgacagtccaaggaatggtcctacagcgtcaacctgtcgctggcgcccgacaccaatatcaatgccggcccgactgcgcgcgaagtgacactctacggcctgcctttcgaactctccgacgatgcccgacatcgcagcggaattggcctcgctgcggacttgagcgtcgaatgggcacctcggattgcccgtaatgcgcgcctgcgcatggggttcaacggccagcgccgcgaatattccgggtcacgcttcgacgacatgaccctgggaacctacatcgggccacgcttcgtcagccgtaagtgggacatctccttgctgggtacgggcttccagcgctggtatgcaggttcaccctacgcgcgatccgccggcacacgcgtggatgcaacccactacctctcaccgaccttcgtgctatcggccagtgcttcggcccagtggctggaccaccagcgcgtgccggcaatgagcggtccgatcctgtcgtttggtgtgagcgcctttcatccgcttaattcgtcgagcgcgctcacggccaagatcggaatcaaccggcaagatgccagagacgcagcctattcaaactggagcggctatgccgcgctgggttattatcgcgatctgccggcgggattctcgatatacattgaaccctcactggcattcgcccgctacgacaaggctgtcccggcgatcggcttgaagcgttcggacagaaccttgtcgggccaggtgaccttgctcaaccggcacatcgtcctgtcacgcttcacaccgcgcctgtcctacactttcacgaagcaggacagcaacgtcccgctctaccgcttcacacgcagtcgtatcgagataggcctgacaacgaacttctga

SEQ ID NO: 402 - protein, 434 aa, N. pentaromativorans
MASSEAAANEPAPVAMNARPSTDAEDAPVVGLEALVEQLLREGRTEEAASILEQFAKDDLHKVRMQFLKGMVALTRRDYREAINRFRVILIDHPDAVRVRLELARAFFMDKDYANADRQFRLTRAGKLPRDVLANIDAYLFAIRQSKEWSYSVNLSLAPDTNINAGPTAREVTLYGLPFELSDDARHRSGIGLAADLSVEWAPRIARNARLRMGFNGQRREYSGSRFDDMTLGTYIGPRFVSRKWDISLLGTGFQRWYAGSPYARSAGTRVDATHYLSPTFVLSASASAQWLDHQRVPAMSGPILSFGVSAFHPLNSSSALTAKIGINRQDARDAAYSNWSGYAALGYYRDLPAGFSIYIEPSLAFARYDKAVPAIGLKRSDRTLSGQVTLLNRHIVLSRFTPRLSYTFTKQDSNVPLYRFTRSRIEIGLTTNF

SEQ ID NO: 403 - DNA, 1383 bp, N. polysaccharea
atggttattttttatttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtaccggggcaggtgcgggaaaaaggaaaagttttgcagattgacggagaaaccctgctgaaaagtcccgaattgctgtcccgcgcgatgtattccgcagtggtcgcaaacaatattgccggtatccgcgttattttgccgatttacctacaacaggcgcagcaggataagatgctggcactttatgcacaagggattttggcgcaggcagacggcagggtaaaggaggcggtttcccattaccgggaactgattgccgcccaacccgacgcgcccgccgtccgtatgcgtttggcggcggcattgtttgaagacaggcagaacgaggcggcggcagaccagttcgaccgcctgaaaacggaaaacctgccgccgcagcttatggaacaagtcgaactgtaccgcaaggcattgcgcgaacgcgatgcgtggaaggtaaacggcggtttcagcgttacccgcgaacacaatatcaaccaagctccgaaacagcagcagtacggcagatggactttcccgaaacaggtggacggcacggcggtcaattaccggctcggcgcggagaaaaaatggtcgctgaaaaacggttggtacacgacggcgggcggagacgtgtccggcagggcttatccggggaacaagaaattcaacgatatgacggcaggcgtttccggcggcatcggttttgccgatcggcgtaaagatgtcgggctggcagtgttccacgaacgccgcacctacggcaacgacgcttattcttacgccaacggcgcgcgcctttatttcaaccgttggcaaaccccgaaatgggtgttttaccggaacgcgcgccaatattggacgggcggtttggatttttaccacgagcgcaaccccgccgaccgaggcgacaattttaatcgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggacagggaattggacacatccttgagcctttggcaccgggcattgcattttaaaggcatcacgccgcgcctgaccttgtcgcaccgcgaaacgtggagtaatgatgtgtttaacgaatatgagaaaaaccgggtgtttgtcgagtttaacaaaacgttctga

SEQ ID NO: 404 - protein, 460 aa, N. polysaccharea
MVIFYFYFCGKTFMPARNRWMLLLPLLASAAYAEETPREPDLRSRPEFRLHEAEVKPIDREKVPGQVREKGKVLQIDGETLLKSPELLSRAMYSAVVANNIAGIRVILPIYLQQAQQDKMLALYAQGILAQADGRVKEAVSHYRELIAAQPDAPAVRMRLAAALFEDRQNEAAADQFDRLKTENLPPQLMEQVELYRKALRERDAWKVNGGFSVTREHNINQAPKQQQYGRWTFPKQVDGTAVNYRLGAEKKWSLKNGWYTTAGGDVSGRAYPGNKKFNDMTAGVSGGIGFADRRKDVGLAVFHERRTYGNDAYSYANGARLYFNRWQTPKWMFYRNARQYWTGGLDFYHERNPADRGDNFNRYGLRFAWGQEWGGSGLSSLLRLGAAKRHYEKPGFFSGFKGERRRDRELDTSLSLWHRALHFKGITPRLTLSHRETWSNDVFNEYEKNRVFVEFNKTF

SEQ ID NO: 405 - DNA, 1518 bp, N. polysaccharea
atgttgtatttcagatacggctttttggttgtttggtgtgcggcaggtgtttctgccgcctatggggcggatgcgcccgcgattttggatgacaaggcattgttgcaggtgcagcggtcggtgtcggataagtgggcggaatcggattggaaagttgaaaatgatgctccgcgcgtggttgacggggattttttgttggcgcatccgaaaatgttggaacatagtttgcgcgacgcgctcaacggcaatcaggcggatttaatcgcttcgttggcggatttgtatgccaagctgccggattatgatgcagttttgtacggcagggcgcgggctttgctggcgaaattggcgggaaggtcggcggaggcggtggtgcggtatcggaagctgcacggggaaaatgcggcagacgagcggattttgctggatttggcggcggcggagtttgacgatttccggctgaagtcggcagaaaggcattttgccgaggcggaaaaattggatttgccgccgccggttttggaaaatgtggggcgttttcggaaaaaagcggaggggctgacgggctggcgtttttcgggcggtatcagcccagcggtcaatcaaaacgccaataatgccgcgccgcaatattgccggcaagacggaggcagtcagatatgcagtgtcagccgggcggagcgggcggcagggttgaattatgaaatcgaggcggaaaaactgacggcgttggcggataatcattatttgttgttccgttccaatatcggcggcacgagctattatttcagtaaaaaatcggcttatgatgacgggttcggcagggcgtatttgggatggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaatgctatcgcgaacaggatagggcggaatacaataacggtcggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggctgggcgcaggagtggcggcagttgggcggtttgaacagtcgggtttccgcgtcttatgcccgccgcaactataagggcgttgcggctttctcgacagaggcgcaacgcaaccgcgaatggaatgtctcgctggctttgagccacgacaagttgtcgtacaaaggtatcgtgccggcgttaaattatcgtttcggcaggacggaaagtaatgtgccgtatgcgaaacgccgcaacagcgaggtgtttgtgtcggcggattggcggttttga

SEQ ID NO: 406 - protein, 505 aa, N. polysaccharea
MLYFRYGFLVVWCAAGVSAAYGADAPAILDDKALLQVQRSVSDKWAESDWKVENDAPRVVDGDFLLAHPKMLEHSLRDALNGNQADLIASLADLYAKLPDYDAVLYGRARALLAKLAGRSAEAVVRYRKLHGENAADERILLDLAAAEFDDFRLKSAERHFAEAEKLDLPPPVLENVGRFRKKAEGLTGWRFSGGISPAVNQNANNAAPQYCRQDGGSQICSVSRAERAAGLNYEIEAEKLTALADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQCYREQDRAEYNNGRQDGFYVSSAKRLGESATVFGGWQFVRFVPKRETVGGAVNNAAYRRNGVYAGWAQEWRQLGGLNSRVSASYARRNYKGVAAFSTEAQRNREWNVSLALSHDKLSYKGIVPALNYRFGRTESNVPYAKRRNSEVFVSADWRF

SEQ ID NO: 407 - DNA, 1668 bp, N. polysaccharea
atgaaaaaatttgctttgcttcttttgtccgtgccgacggcggccgtttccgaaacgcccgtcttacctatacccgtgtcgaaacaggtgttcgtggacggcaaattcgacgataggatagtgcctgccgaaaggcttgaaaggtctggcgaaacagaaatgccggttctgccgcttgcttcctatgccccatcttttgacgaacagatcgacaatgccttccgcctgttacagcgtgccgcgccgaagcgggctgccgcgcctgttgttgctcctgccggagagtcggaagagaccgaaatcaagcctgtggcaacacataagaagttttccaacgaggcggctttcggtacgggtgcgtccgtgccgtctgaaacccttgcagccggagaagccgccgaagccgtttcagacggcaatgcctctcttgcgggtttggaagagcagatcaaccgcgccgtcgtcgcccgtgattgggacacgctgcaaacgctgctggaaagctaccgcgccctgccggatttcaatccggttctgcacgattacgcgctgggcggtttgcgccgcagccagttgcgccataacgaggcggtggctttgtatcgcggcattttggcgcaacagcccgatttggcgtatccgcgtttcgatttgggcgtgatgctgtttgaaaacaaacagtaccgcgaggcgaaggcggaattggatcgggcgaaacccgatttgcagccgccgatgcagcagcttgccgaccgctatcttgccgccatagacaaggctcaaggctggaagcccgatgtgtcgctgcaatacgaacaaacggacaatgtgaacaacgcttcatccgaaaaaacgattgaatttgcaggcagaagctggacgaaaaccgccgacagcctgccgcaaaaggcacacggtttgcgctacggcttgggcgtgtcgcgcgaaatcaatgcgggcgggcatcatttcctctacggcgacatcagcggcggcggcgtgcactattgggataacaaagatttcagcgaacagagcctgcgcctgtcgctcggctataaaaaccgttcagtaacgcgctcgttcggcatcgtgccgtttatcgagcaaaacctcttaggcggcagccgatacaatttcgtcggcggcttcaatgccgatttctcccaacgcttgagcgaacgctggcggttgacgctgaacgcgggcaatatgtggaagcgttatcaggaagaccgcaccgccgcccgatacgacagccatatgccgctggcgggcgcgacgctgatgtattccgcgccgaaagactggctgctttacggcggtgcggactggtcgcacgacttgacgaaggaggcggaacaggcttccatccgcaagggtttgcgtgtcggcgcggtcaaaacgttcgacggcgggctgggtctgcgggcaaacctgcgctatacccgcaggacgtttgacgcacccgggaccattgtgtaccgcttcccgcgcaaagaccgcgaatatcaggcaaacctgtcgttgtggcacgacaaaatctcttggaagggatttacgccgcaactcaatttccgctatctgaaaatcgacagcaatatgaaaagtttttacacacgcaaaaacacgcagattttcatgagtgtggaaaaggatttcaaataa

SEQ ID NO: 408 - protein, 555 aa, N. polysaccharea
MKKFALLLLSVPTAAVSETPVLPIPVSKQVFVDGKFDDRIVPAERLERSGETEMPVLPLASYAPSFDEQIDNAFRLLQRAAPKRAAAPVVAPAGESEETEIKPVATHKKFSNEAAFGTGASVPSETLAAGEAAEAVSDGNASLAGLEEQINRAVVARDWDTLQTLLESYRALPDFNPVLHDYALGGLRRSQLRHNEAVALYRGILAQQPDLAYPRFDLGVMLFENKQYREAKAELDRAKPDLQPPMQQLADRYLAAIDKAQGWKPDVSLQYEQTDNVNNASSEKTIEFAGRSWTKTADSLPQKAHGLRYGLGVSREINAGGHHFLYGDISGGGVHYWDNKDFSEQSLRLSLGYKNRSVTRSFGIVPFIEQNLLGGSRYNFVGGFNADFSQRLSERWRLTLNAGNMWKRYQEDRTAARYDSHMPLAGATLMYSAPKDWLLYGGADWSHDLTKEAEQASIRKGLRVGAVKTFDGGLGLRANLRYTRRTFDAPGTIVYRFPRKDREYQANLSLWHDKISWKGFTPQLNFRYLKIDSNMKSFYTRKNTQIFMSVEKDFK

SEQ ID NO: 409 - DNA, 1518 bp, N. resinovorum
atgccgattttgaattttgccattgcatcgcgttgtcgaacgggtctgacaacgcttctgtgtgccgccgctccatgcgtttcggtccctgttctggcacagagcacagcggaacaggataccaggctgcgccttgatcaggagttgcaggggcaggagcgcaagacagagtcccggcttctcgaagatgccgacgcgctggacgggcccccgacgtcgctggaaatcgacggcaagacttacgcggtcggcgataatgtcgatgagatgggacaggccctctatattgcgatccggcgccgcatatggagcgaggctcgccgttttctgacggcctatgagggatacacagatcgtgatcccaaactcgtgcttttcgccaagggcgcgcttgcgcgccaggatcgcaagctgggtgaagccgaacggcattatcgtgcactggtggagctcgaccccgatctcatgtcgggccaactagaactggcgcgggtcttgttcgaaaaccgcaaggaccgtgaagcgcaggacgccttccggcaggtgcgcgaacgcctggttgtcgatggcgacagatcgacgggggtggtccgtaccgtagacgcctttctcctggcgttgagacagcggcggggctggcaaggcaatatcgccataggccccagctacagcaccaatctcaatcaatcgtccgaaagctacacctgcctgctggcgaccagcgacggcacttgcctgttcgaccggcagttgcccgatgcggtaaaggccatggggatcagtttcgaaggctcgctcaaccgcagcattccgatatcgggccatcacggtttgcgcgcccgcgcgctccttttcggcgatgtgtacccaagtgaacatgagtactcgcaagccagcctcatcatgcggcttggctaccaatatcagtctgcgcgtgacacgttctcgctgtcgccatcctttgacattgggacgttaggttcatccgtcctctacgatgcctggggcgcaaatgccgagtggcagcataccctgtcccgtaaagtactgctccggcttgagggcaattatcgcgactatcgctaccggcagcgcggtttcagttcccaggatggcccgctcatcgataccagcctgaccgcgtggtatacgccggcgccgggatggacggtgtttggcggcccggatcttgccgtgaaggacactccggcggccaccaacgcctaccggcaatggggcgggcgcttggggatcggcaggacgctaggcaaaagcgccagccttcttcttctcggttcctaccggcatcgcgataaccgcgcctatagcgccgtcttcgccgccaagcggagcgatgaccagttcaatgccacggcgatcgcgcgcttccccggtttcgctttcgccgggctgacgcctgaggttgtgttccagcacaatcgcgtcgaaagcaacatcgactggctctattcctacaagcgcaccaccgccagcgtgaggctgagccgtgcgttctag

SEQ ID NO: 410 - protein, 505 aa, N. resinovorum
MPILNFAIASRCRTGLTTLLCAAAPCVSVPVLAQSTAEQDTRLRLDQELQGQERKTESRLLEDADALDGPPTSLEIDGKTYAVGDNVDEMGQALYIAIRRRIWSEARRFLTAYEGYTDRDPKLVLFAKGALARQDRKLGEAERHYRALVELDPDLMSGQLELARVLFENRKDREAQDAFRQVRERLVVDGDRSTGVVRTVDAFLLALRQRRGWQGNIAIGPSYSTNLNQSSESYTCLLATSDGTCLFDRQLPDAVKAMGISFEGSLNRSIPISGHHGLRARALLFGDVYPSEHEYSQASLIMRLGYQYQSARDTFSLSPSFDIGTLGSSVLYDAWGANAEWQHTLSRKVLLRLEGNYRDYRYRQRGFSSQDGPLIDTSLTAWYTPAPGWTVFGGPDLAVKDTPAATNAYRQWGGRLGIGRTLGKSASLLLLGSYRHRDNRAYSAVFAAKRSDDQFNATAIARFPGFAFAGLTPEVVFQHNRVESNIDWLYSYKRTTASVRLSRAF

SEQ ID NO: 411 - DNA, 1407 bp, N. rosorum
atgaaacgattaattatttcttcggtcgtactcgccggtttcgatgcggcggcgaatgtgcctatacaaaaccgtgatccgatatcttttgaacaaagtgcggtagatataaagcaattttcttccatggcttttgatgataatacgaaaaaagacatttcaccggtattaacggtttcagatacaaatcaacaaattaatcaggcgattttactgaaacaatgggatgtattagcggcattattgtcggattatcctgatcaggcacaatttgatccgattttatatcattatgctgcggccgcattaagttatgccaaaggacaacatggcgacgcaatatatcactatgagcaagtattatcgttggatccgagcctgacctattctcgctttgatctggcattgattttatttgaagataaacagtttgatgcggctcggcagcagttccagcttgcatatggcaggctggatccgcaaatgagaacagtaacgcaatcctatctgcaagccattgatgaggcgcagtcatggcgaacggatttttatctgcaatatacccaaaccagtaatgtcaacaatgtttccccgtcgcgcgtggttaatattaacggacgacaatttatcaaatcggaagattcattaccgcaatccgcacacggatttaattatggcatggatattgaacgtgatatcaatctgcacgggcatcattttttatcaagtgcggttaaattcgggggtgtttattattgggataatcaggaatataacgaacaaacgctgcattttgcgctgggatatcggtataaaaatgcgcgacaaacgttcggcgttctgccgtttgcagaacaaaattggtttgggcattctcgttacaataagcaattcggcgtgcaactgaagcatcagtacaaatggaatcagcgctggcaatcagcactgaattttaatcattactataaacgttatcgtgatgagctaaccgcatggcgttataacagttggcagaatgaagcgacaggattactgttttggcaaccgacagggcattggcggctgtttggcgggctagaactgaatcgggagaacactaaagagaaagccttgtcgtcacataaaataggcggcattggcggtcttgtttatcaggcgcctttatggggcggaatgatgacgctacgttatagcgaacggcattttgaagggaagcattatctttatggctatccacgtcaggatcgggaatatcagtcattgatctcaatctggcatgaaaaaataagctggaagggaatcttgccgaaactgaatttcaaatggcaaaaaattgacagtaatattccggatttttattcacgcacgaataaatccatgtttatcactctggaaaaacgattttga

SEQ ID NO: 412 - protein, 468 aa, N. rosorum
MKRLIISSVVLAGFDAAANVPIQNRDPISFEQSAVDIKQFSSMAFDDNTKKDISPVLTVSDTNQQINQAILLKQWDVLAALLSDYPDQAQFDPILYHYAAAALSYAKGQHGDAIYHYEQVLSLDPSLTYSRFDLALILFEDKQFDAARQQFQLAYGRLDPQMRTVTQSYLQAIDEAQSWRTDFYLQYTQTSNVNNVSPSRVVNINGRQFIKSEDSLPQSAHGFNYGMDIERDINLHGHHFLSSAVKFGGVYYWDNQEYNEQTLHFALGYRYKNARQTFGVLPFAEQNWFGHSRYNKQFGVQLKHQYKWNQRWQSALNFNHYYKRYRDELTAWRYNSWQNEATGLLFWQPTGHWRLFGGLELNRENTKEKALSSHKIGGIGGLVYQAPLWGGMMTLRYSERHFEGKHYLYGYPRQDREYQSLISIWHEKISWKGILPKLNFKWQKIDSNIPDFYSRTNKSMFITLEKRF

SEQ ID NO: 413 - DNA, 1494 bp, N. rosorum
atgtatcgcttaacattcaatcacttcaaaacatgcaacgccgcgttccgtttgttgctgctcttgctcccggcttatacggcgcagtatgccgccgcgcaagtgcaaaacaaccacgacgcccttcagctctggcagcagcataagcaagccagccggcagcaacaacgagaaagccgggttgatcagccgatcgccgaagccgcacacgaaatgatctttgacggccaatcgatcacgattgacaataccgccgaggcagtcggacaggcgctgtttatcgccctcaatcagcaattatgggattatgcgcaaacatttctgcgccattataaaaccttcgacgaccataatctcgaactggtgttatttgccgaggcggcgctggcacgtcagcacggcgatctgaatcgcgccgaacagcgctatcgcgagctgctgcgggcggatccgacctttatccgcgctcagctcgatctggcgcgcgtgctgttcgaaaataaaaaaacgcgggaatccaccgcactttttgagaatctggcaaggctggatctgccggctgaagtccgtgacagcgtcgacggctatcgtcaggcattaagcctgcgggaaaaatggcagctgtctttcgctctgggctatcagtacgccaccaatatcaaccagtcttcccgacgcagcctgtgcgcgctgtatctgggcgagatctgttccgcccgattcacttcgcccgacgccataaatgcgcagggctggcgctatgatctcagtgtacggaagcaaaccgctttatccggtcatcacgggataatattttatctcaacagctacggttatttttatccccatgccaaggattatgccgaagataacagcaaagtttatgtcggttatcagtaccaaaatcagcacaccgaactgacccttgcgccgttgttcgaatataaccggctgggcaaccgcacttattcgcgggcatggggcgtacagcttgccttaagccggcaaatggccgcccgccattggctgaatttgcagttcgaacagaaaaaactgcgcttttccccgcactataatgcgctgcgtcatgcggatcagagcgcgctgtatgccacttggtattatgccgccggcgcacaaaccactttattcggcgggctggactggcaatatcggcacacccgatatcacgacgacaactttcatatgtacggcgttcgtttaggccttaaccggcaatttgatttcgggctggacgccaccctgctggcgttattgcgccgttatgattatcaaggtttcaacgcggcactcaaccgaacccgacacgataaacagcaggtttatctggcgatccttaaaatgccgtcgtggcaattttacggcgcaacgccgagcctgttgctgaaacgcaccgacaaccgcagtaacgtggattggctgtatgcttataaacagaatgaaattcaactgaatatcgaatggcaattttaa

SEQ ID NO: 414 - protein, 480 aa, N. rosorum
MLLLLLPAYTAQYAAAQVQNNHDALQLWQQHKQASRQQQRESRVDQPIAEAAHEMIFDGQSITIDNTAEAVGQALFIALNQQLWDYAQTFLRHYKTFDDHNLELVLFAEAALARQHGDLNRAEQRYRELLRADPTFIRAQLDLARVLFENKKTRESTALFENLARLDLPAEVRDSVDGYRQALSLREKWQLSFALGYQYATNINQSSRRSLCALYLGEICSARFTSPDAINAQGWRYDLSVRKQTALSGHHGIIFYLNSYGYFYPHAKDYAEDNSKVYVGYQYQNQHTELTLAPLFEYNRLGNRTYSRAWGVQLALSRQMAARHWLNLQFEQKKLRFSPHYNALRHADQSALYATWYYAAGAQTTLFGGLDWQYRHTRYHDDNFHMYGVRLGLNRQFDFGLDATLLALLRRYDYQGFNAALNRTRHDKQQVYLAILKMPSWQFYGATPSLLLKRTDNRSNVDWLYAYKQNEIQLNIEWQF

SEQ ID NO: 415 - DNA, 1443 bp, N. shayeganii
atgtctttacaccttccccgcctatccctgttcggctgtatctgcctgctccccgccctgctgtacgcccaaacgccgccggccctgcctaggccgcaaccggaaacccgtttcgacatcagccccgaaatccgttccgacgcaccgcctgccgcacacactacaggtagcccggaccctcaacagccgctcaacatcagccccgaagagctgctgcaaaaccctgagttgctgcatcgcgccctgcagtcttccgtactgctcaacaacctcgaaggcgtgcgtctgctgctgccgctctaccgccagctgcccccgccgcacgaagaaatgctgctggtgctggccgatgccatgatcgcccgtgcagatggaaaatacaatcaagccgttaccgcctaccgccgggccctttcgctggagccggatatgcccgccgtgcgcctgtcgctggcgcaatccctgtttgaaaaccacgaaaacgaagccgcccgcgaccaattcacccgcctgcgcgccgacggacaactgccgcccgaaatccgccaactggtcgaccattacctcaccgccctcgatcaacgcaacacttggtctttctacggcagcctccactatctgcgcgacggcaacatcaacaatgcccccgccaaccgcaccttccgcaccgccaacggcgaattcaccttccccgaacccgaatccgcagaaggcctggcctaccgcctcggcggcgcacgcgactggctgctgggcggccattggtcgctgcgtaccgctgccgacgcttccggcaaatggtattggaacaaccgcccatacgatgacgcctcagcccgcctgaccgttggcggcgcctacaaaaccgcccgcgccgaagccgccctgctgccctatttcgaacgccgctggttcggcaaccgcgcctatttgcgcgaagccggcctgcgcgccgaatggcgctactggctcgcacccggccaccagcttctgctggccggcgaatgggggcagcagcagcacgaccgccgcacctttctcgacggccccaaccgcaatgtttccgccacttggctgtatattcaaaacccgcgccaatactggattttgggcacagactacgcccgcaagagcgcccgcgaccgcagcgacacctatcagcgcaacagcctgcgtgccggctggaccagggaatggtcgtacggcctctccaccgccctcacggccgaagccggcttgcgccgatacgacggcccggatttcctcaacatccgccgagaagacaaagaatacgccgccagcctgtctgtctggcaccgccgcgtccacttctggggcatcaccccccgcttggtgggcacctggcaaaagagcgacagcaaccacccgctttaccgtttccaaaaaagcaatctgtttatccaaatcggcaaaaccttttag

SEQ ID NO: 416 - protein, 480 aa, N. shayeganii
MSLHLPRLSLFGCICLLPALLYAQTPPALPRPQPETRFDISPEIRSDAPPAAHTTGSPDPQQPLNISPEELLQNPELLHRALQSSVLLNNLEGVRLLLPLYRQLPPPHEEMLLVLADAMIARADGKYNQAVTAYRRALSLEPDMPAVRLSLAQSLFENHENEAARDQFTRLRADGQLPPEIRQLVDHYLTALDQRNTWSFYGSLHYLRDGNINNAPANRTFRTANGEFTFPEPESAEGLAYRLGGARDWLLGGHWSLRTAADASGKWYWNNRPYDDASARLTVGGAYKTARAEAALLPYFERRWFGNRAYLREAGLRAEWRYWLAPGHQLLLAGEWGQQQHDRRTFLDGPNRNVSATWLYIQNPRQYWILGTDYARKSARDRSDTYQRNSLRAGWTREWSYGLSTALTAEAGLRRYDGPDFLNIRREDKEYAASLSVWHRRVHFWGITPRLVGTWQKSDSNHPLYRFQKSNLFIQIGKTF

SEQ ID NO: 417 - DNA, 1488 bp, N. shayeganii
atgaacaaaatgacccacacccactccatcatgcttggcgccctgatggcattacttgtgcccatcagcgcagccgcccccaccgatgccgctgctccggtgccaaacgccaatgaaaccgctgccgaggaaatccccgtattgagggcggccgatttggcccgctacccgcaactgctgacggaaatgatcgagtcggcgctggaccggcaacaccccgagctgttaaacgagctgctgccggtctatgccgccaccgtcagcgccgacgactatctactccgacgcgccaccggcatggcggcgcgcttccgcagagactacgccgaagcgattgccgtctaccaacaactggcgacagaaagaccggcggatgtgcgagtgcgcttggacttggcggccatgctggccgaagacaagcaatggccggaagcggaaaagctgtttgcagaggtcaggcggcaggagggactgccgccccaagtgggcgaaaacgtccaacactatctgaatgccgccgaataccggcggcgttggcagtgggacggcggcgtttcgcccgcattcaacgacaacatcaataatgcggcgagagagcattgcagcatcatcggctgcagccgcgagcgctcggaaaatgccgccggcctggcatacagcatccgcgtcagccggcaagtgcccttggccggccaccacaatttgtttttcgaagcgcgcgcagacggccaaacccattattggagcaataaatcggcctacgattgggggcagggccgcatcggtttgggttggctgtatcaagatgcgcggcaagatttgctgctcagtccgttttaccaaatcgatttgagtggcagcgacaattggggcggcagcaagccgcaacagacacaaaccttcaatatggatacttgggcgcacggctacggcatcagggcgcaataccagcggcaactgtctgcacgctggcaagcctcgcttgccgccgacatcacccgccgccattaccgccatgcaccgcaagcggagcagcaaaacggatggtacagcggccagagtgccggcatccactggcaagccggcgcccgcgatgggctttatggcggcatatttttcaatcaagccttccccgagcaacgcaccattcagggccgcgccaataatacggcctaccgccgctacggcctgcaagccggttggatacacgactgggcttggctgggcggtctctccacccgcgtttccgcctctgtcgcccaacggcggtttaaaggagagtcgctcaacgtgaccgcgcaaggctttcctttgcagcagcggcgcgaccgcgaatatcaatatggtctcgcggtatggcatcgcgcttggacaatctggggcatgacgccgaagctgaatctgtcgcggcaggaaatccgcagcagccacacttgggcacagcgtaaaaacagccaagtctttatcgaactggaacggcggttttaa

SEQ ID NO: 418 - protein, 495 aa, N. shayeganii
MNKMTHTHSIMLGALMALLVPISAAAPTDAAAPVPNANETAAEEIPVLRAADLARYPQLLTEMIESALDRQHPELLNELLPVYAATVSADDYLLRRATGMAARFRRDYAEAIAVYQQLATERPADVRVRLDLAAMLAEDKQWPEAEKLFAEVRRQEGLPPQVGENVQHYLNAAEYRRRWQWDGGVSPAFNDNINNAAREHCSIIGCSRERSENAAGLAYSIRVSRQVPLAGHHNLFFEARADGQTHYWSNKSAYDWGQGRIGLGWLYQDARQDLLLSPFYQIDLSGSDNWGGSKPQQTQTFNMDTWAHGYGIRAQYQRQLSARWQASLAADITRRHYRHAPQAEQQNGWYSGQSAGIHWQAGARDGLYGGIFFNQAFPEQRTIQGRANNTAYRRYGLQAGWIHDWAWLGGLSTRVSASVAQRRFKGESLNVTAQGFPLQQRRDREYQYGLAVWHRAWTIWGMTPKLNLSRQEIRSSHTWAQRKNSQVFIELERRF

SEQ ID NO: 419 - DNA, 1515 bp, N. sicca
atgcccgaaagcacccaaatgctcgatatggtttcgcctcaaataaaaaacgcagattcatgcgccattgcaacccaaacgtcttacgaaatcatgaaaacactcttactcctctccctgctcgccgtgtccgcagcagaagccgccgacgtgccgtccgagcctcaaaaccagcctgcccccgagttgcaggtcaaaacggcagaacctgcccccgtcgaagaagcagcggccaagcctgctgccgaaacgtcgtctgaaaaagtcgtcaacgtcgatgccaaaaccctgctcgacaatccccaattgctttcccgcgccatgtattccgccgttgtgtcgcgcaacatcgcgggcatcaaagtcgtcctgccgatttacgaacaatggccgggacacgataaaaacatggcgctctacgcgcacggattggttgcccaagatgaaggcaaaatgaaagaagccatcgggtattaccgtcaatttatcgccgaaaaccccaatgcccccgtcgtccgctggcagcttgccaccgctttgtttgaagacaagcaaaacgaagccgccgccgaccagttcgacaaactcaaaacagaagccaacctgcccgagccgctcgtcaaaggcatcgaatcctaccgcaaagcattgcgcgagcgcgattcgtggaaattcaatgccggcttgagcgttacccgcgaacaaaacatcaaccaagcgcccagccgccgcacatacggcaactggaccttccccgagcctatcgacgctaccgccatcaactaccaactcggcgcagagaaaaaatggtcgctgcccaaaggctggtacgttacggcaggcgcggacaattacggcaaaatttatcccgaacaaaccaagtataacgacgtgaccacccgcttttcggtaggcgcaggctacgccgaccagcgcaacgacatcggcttgaccccgttccacgaacgccgcttctacggcaacgacccgtatacctactccagcggtgcgcgcctgcacatcaaccgctggtggcagcctaagctgcaaaccttgagcgccgttgaaatgggtcgtctgaaaaacacccgccgcgcccgttccgacagcaacaaccgcctgttgagcaattccgtcgtctattaccgaaacgcccgccaatactgggtcggcggtttcgacatttatcaggaacgcaataaagaagacaaatcggacagcttcgaccgttacagcctccgtaccgcatgggggcaggaatggggcaaagggctgtccaccatgttgcggctgagtgcggcacaacgccgttatcaaacgcccagccttttgagcggtcaggaaaaccgccgcgataaagaagcggatatttctctcgccgtgtggcaccgcgctttccacttcaaaggcatcaccccgcgcctgaccgtcgcccaccacaaaacgtggagcaacgacaaatactacgaatacggcaaaaccagaatgtttgtcgaattcagcaaaacgttctga

SEQ ID NO: 420 - protein, 504 aa, N. sicca
MPESTQMLDMVSPQIKNADSCAIATQTSYEIMKTLLLLSLLAVSAAEAADVPSEPQNQPAPELQVKTAEPAPVEEAAAKPAAETSSEKVVNVDAKTLLDNPQLLSRAMYSAVVSRNIAGIKVVLPIYEQWPGHDKNMALYAHGLVAQDEGKMKEAIGYYRQFIAENPNAPVVRWQLATALFEDKQNEAAADQFDKLKTEANLPEPLVKGIESYRKALRERDSWKFNAGLSVTREQNINQAPSRRTYGNWTFPEPIDATAINYQLGAEKKWSLPKGWYVTAGADNYGKIYPEQTKYNDVTTRFSVGAGYADQRNDIGLTPFHERRFYGNDPYTYSSGARLHINRWWQPKLQTLSAVEMGRLKNTRRARSDSNNRLLSNSVVYYRNARQYWVGGFDIYQERNKEDKSDSFDRYSLRTAWGQEWGKGLSTMLRLSAAQRRYQTPSLLSGQENRRDKEADISLAVWHRAFHFKGITPRLTVAHHKTWSNDKYYEYGKTRMFVEFSKTF

SEQ ID NO: 421 - DNA, 1464 bp, N. sicca
atgaaatctaatcaattcatttttattgcgggcatattatttcccataatggttactgccgaaacaattgctaaccctgaaactgaagccgatcgccaaatggaaaggatacaagaaatggccattcctaaaccaccggaggtaggcacctcccttttgaatggtgtcaaggcttctttgaatgagcatactcagacattgacattagatgatctagccaaacaaccagagctggccgaacctttgttaaatcaagcattgcaagcgcgaaactatattgctgcagagcaactcttgcctatatatcgtaaatggaatgggtatgacccaattttattggattatgcgcaaggcgcaatttggcgttcgcaaggaaagcataaaaaagccattacactttaccgtaatatccttgttcgacatcctaatcttgttgccgtccgtctagacttggctgctatgctttatgaggataagcaaacccgtaattcacaacatgaatttaatgctgccaaaaagcaaggtttaccagaagatgtccttcctactattgccctttatgaaaacgctatggggcaaaataaatggcaattttcaggcagtctgagttacacccaagacaacaatatcaacaacgtttcagctgagcgtgaaatccatcttcctcaatttgataacttggcttttgaaaaaaattctgactatctgccacaaaaagggcatggttttacctacgccctatccgttgatcgcgatatcaatctcaaaggcaaccattatttcgctctttcaggcgatgtcgacggcgtcagctattgggataatcatgattatgatgatcaaacggcaaaagtcagtctaggttataaaaataaaagttttaaaacagatagttttgttatgccatttttagaaaagcgtcgctacggaaatcatccttattacacgcgtacaggtgtagatttaggtgcttcacgttggataaaaccaaatttacgcctatctgccaacggaacctttgcacaaaaagattatgcctataccaaacaacaagggaaagattatcagattggatttgggacgacctacctgatgaatgataaaacctatttcttaggaggtttgagttatgcgcgtgacaaagttgaaaatttcgcaggcagcagctccaaacggataggaggttacttaggttgggggcaaatttggggtgaaaatttcaatagtcgccttatcatcaatcactacaatgaacgctttgatggaaaacattacgtctttaccgaccgtcatcgtacagataatgtcgtggttaccaatttaagcctctggcacaataaacttagttttctaggaattacgccgagattaaattggcgatatacaaacaataacagcaatattaacgaacttcatagttatactaaaaatcgcgtatttatagattttgagaaaacgttttga

SEQ ID NO: 422 - protein, 487 aa, N. sicca
MKSNQFIFIAGILFPIMVTAETIANPETEADRQMERIQEMAIPKPPEVGTSLLNGVKASLNEHTQTLTLDDLAKQPELAEPLLNQALQARNYIAAEQLLPIYRKWNGYDPILLDYAQGAIWRSQGKHKKAITLYRNILVRHPNLVAVRLDLAAMLYEDKQTRNSQHEFNAAKKQGLPEDVLPTIALYENAMGQNKWQFSGSLSYTQDNNINNVSAEREIHLPQFDNLAFEKNSDYLPQKGHGFTYALSVDRDINLKGNHYFALSGDVDGVSYWDNHDYDDQTAKVSLGYKNKSFKTDSFVMPFLEKRRYGNHPYYTRTGVDLGASRWIKPNLRLSANGTFAQKDYAYTKQQGKDYQIGFGTTYLMNDKTYFLGGLSYARDKVENFAGSSSKRIGGYLGWGQIWGENFNSRLIINHYNERFDGKHYVFTDRHRTDNVVVTNLSLWHNKLSFLGITPRLNWRYTNNNSNINELHSYTKNRVFIDFEKTF

SEQ ID NO: 423 - DNA, 1440 bp, N. sicca
atgtacaaaccgtctgcctgccttatcctctttctcgccgcccccgtccttgccgcgccacgttctgacttttcagacgaccgtaccgcgcaacgcctgtggcaggatacccgccaaaccatgcaggaacaggaacaaaaagtgcgcgaataccgcctcgacattcccgccgaaaacatcgggcagacagccgaaaccgaccccgaagccgaccaaggcgaagccttgtttaacgccgtcaaccgcagcgactggcaaaccgtgcgcccgctgctcgagcgttatacccagcaaaccgaatacgaccccgacatcgccctctttgcccgcgcctcgctcgcccgtggcgaaggcaggtggaaagatgccaaacaagactacgaaaccctgctgcaacgccatcccgacttcacgcgcggacggctcgattacgcccgcctgctctttgaaggtcgtctgaaccgcgaagccacttccgaatttatgcgcctgcaaaacgaagacctgcccgaagccgtcaaagaaaacatcggccatttccgcgattccttaaaccaacgccaaagctggcagggcagcctttccgtcggcgccgtccacaacagcaacatcaacgaagccagcggcaaagtgtggtgtaaaaccgaaatcgacggcgaatgctgggaagaattttccggcgacctgcccatttccgccaacggcatcaaatacgaagccgccgccgtccgccgctggcagattaaaggacaccacggcatcgccgcccgcgcgctcggctacagccgcttctaccgcgaccataaagacttcaacgaacacacgctcaacctcagcgcaggctaccagtttgaaaaccaccgccacaccttcgccctcgccccgctcgtcgaatggaacggcagcggcggcaaaaccctcaaccgcgcctacggcgtgcgcagcgagtggaacctcgacaaaggcagctggacgtggaacaccgaagccgagtggaaacacctctcctattccgacaaaacccgcctgctcgacggcagcctcttctccgtttacaacaccctgtcctacttcccgcgcaacgacctcatgctctacggcggcatagactggcagcagcgcaaagccaaagaacccgtggacagctaccgcctcatctccgcacggctgggcgcagcaaaaatgtttgaagccggcttcgacgcctccgcctccgccaccttcggcatccgcagccaccgcgaagaaaacgccgtactcgaacaacgccgccgcgacaaagaacaaacctaccgcctcagcataggcgcggaccgctggaaattcgccggcctcaagcccgtcctcagctacaaacaccgccgcgtcaaaggcaacaccgactggctatacagctacaaacaaaacgaagtcggtctgtcgctggtgaaatcgttctaa

SEQ ID NO: 424 - protein, 479 aa, N. sicca
MYKPSACLILFLAAPVLAAPRSDFSDDRTAQRLWQDTRQTMQEQEQKVREYRLDIPAENIGQTAETDPEADQGEALFNAVNRSDWQTVRPLLERYTQQTEYDPDIALFARASLARGEGRWKDAKQDYETLLQRHPDFTRGRLDYARLLFEGRLNREATSEFMRLQNEDLPEAVKENIGHFRDSLNQRQSWQGSLSVGAVHNSNINEASGKVWCKTEIDGECWEEFSGDLPISANGIKYEAAAVRRWQIKGHHGIAARALGYSRFYRDHKDFNEHTLNLSAGYQFENHRHTFALAPLVEWNGSGGKTLNRAYGVRSEWNLDKGSWTWNTEAEWKHLSYSDKTRLLDGSLFSVYNTLSYFPRNDLMLYGGIDWQQRKAKEPVDSYRLISARLGAAKMFEAGFDASASATFGIRSHREENAVLEQRRRDKEQTYRLSIGADRWKFAGLKPVLSYKHRRVKGNTDWLYSYKQNEVGLSLVKSF

SEQ ID NO: 425 - DNA, 1476 bp, N. sicca
atgaacaaatcctgcctcctcctgctcgccctactgcccctgtccgcccacgcagacagcgacgacctgcgccgcctgtccgaagaaaacgggcgcgtgcagcagcaatatcgggaaagcgactggctggacggcggcacacccgcaggcgacatcgaaaacgacgacgcatacatccgcatcggcggtcagatttacaccgtaggcaacaataccgaagagctggaaagcgcgatttatcatgccattaacgaacgccaatggaaaaaggctgaacgcttcgccacgcgctacgccgccctgcccgaccacaatcccgccctgcccaaattggtgctcggtttaaaacaacgcgccgaaggacgcctcgccgaagccttgcgaaacctgcaatcggcagaagcactcgaccccgccaacccgcgcatcctgctcgaaaccgcgcgcctttataccgaagacaatcaaaaccgcgaagcccgaagcgcattcgcccgcgcccaagccgccgatattcccgaagaaacccgcgccctgatcggacaatacctcggcgaaatcgacaaacgcagccgctggcacggacaaatcggcatcgcttacggctacaacagcaacatcaaccaatccgacggctccgtccgctgcatcctgccgcttgacggccaatgcctcgcctaccaaaacctgcccgaccccatccgttcccccgtatggaattacagcctgagcgcaggcaaaatcacccccgtcaaaggacaccacagcctcaaaaccaacctcctcgcctacggcacgcactaccgccgcaaagacacagacaccgccctgtccgactacggcagccaaacaggcacactgtccgccggttacgaatacgccgacgcacaaagccgcctctcgatgatgcccgtttacgaacacgaacggcgcaaccgccacacctactacaacgcctacggcgccgaaacctcgtggacgcataccatcaaccccaaatggcaggtcaacgccgactggtcgggcaaacgctaccgccacagcggcaccgcgaaaacctacgccgccgactacaccgaataccgcacaggcttaggcgcagaatacgccctgaccccgaaaaccggcgtgttcgcaggctccgactacacccgccgcacatacaacggcggcacatccgaccaccgcgaatacaccctccgcacaggcttatacaccctgtttgacaacggcacctacctcaacgccctcgtcatgaaacggcgcaacctctacgaccgcgcaggcatcgccgcagacggacaaagacgcagcgaccgccaaaccgtctggctcgccgccgcaggcttcagacaatggcacatcggcggcttctaccccgaactgcgcttcaaacacaccaccgtcaaaagcaattccgtgttctaccgctaccgccaaaacgaaatcatgctgggcgtgaaaaaacagttttga

SEQ ID NO: 426 - protein, 491 aa, N. sicca
MNKSCLLLLALLPLSAHADSDDLRRLSEENGRVQQQYRESDWLDGGTPAGDIENDDAYIRIGGQIYTVGNNTEELESAIYHAINERQWKKAERFATRYAALPDHNPALPKLVLGLKQRAEGRLAEALRNLQSAEALDPANPRILLETARLYTEDNQNREARSAFARAQAADIPEETRALIGQYLGEIDKRSRWHGQIGIAYGYNSNINQSDGSVRCILPLDGQCLAYQNLPDPIRSPVWNYSLSAGKITPVKGHHSLKTNLLAYGTHYRRKDTDTALSDYGSQTGTLSAGYEYADAQSRLSMMPVYEHERRNRHTYYNAYGAETSWTHTINPKWQVNADWSGKRYRHSGTAKTYAADYTEYRTGLGAEYALTPKTGVFAGSDYTRRTYNGGTSDHREYTLRTGLYTLFDNGTYLNALVMKRRNLYDRAGIAADGQRRSDRQTVWLAAAGFRQWHIGGFYPELRFKHTTVKSNSVFYRYRQNEIMLGVKKQF

SEQ ID NO: 427 - DNA, 1557 bp, N. subflava
atggcactcggtttgcaaaatttccgactcaaaacattgtacaatctgcccacttataccgataacatccccaacattgccatgaaaaaacgtctgctcctcctcgccatcctgcccctttccctttacgccgccgatgtgccgcccaacgtaaaacccgagcttcaagtcaacactgccgaaccccaacagcccgaagcgcacaatatccctgccgaacagacaaacaggccgtctgaaaaaatcatcgacgtcgatgccgacaccctgcttgccaacaccgaattactggcacgcgccatgtattccgccgtcgtcgcccacaatatccccggcatcaaagccgttttgcccatttacgaacaatggcccgaacacgaccgtgccatggcacgctatgccaaaggtttgcttgcccaatccgaagggcgcgccgccgaagccgtcggccattaccgccgctttatcgccgagcagcccgatgcctccgccgtccgctggcagcttgcaaccgccttgtttgaagacaaacaaaacgaagccgcggccgaccagttcgacaaactgcaaaccgaatccctcccgcctgccttgcaagaacgcatcgaaacctaccgcaaagccctgcgcgaacgcgacttatggcaattcaacgccggcctgaacatcacgcgcgaacaaaacatcaaccaagcccccagccaacgccgtctgggcaaccacctgagcgacgaacaatgccgcgccgtgcgccttgtctatcccgacgacgactgcttccgaggctggacattccccgaacccatcgatgccaccgccgtccattaccaaatcggtgcagaaaaaaaatggtcgttgccacgtggcttctatgtcacggcaggcgcagaccattacggcaaaatctaccccaaacacaccaactacaacgacctcaccacacgcttctcggcaggcctaggctatgccgaccagcgcagcgatatcggcattaccccgttccacgaacgccgcttctacggcaacgacccctacacctacaccaacggcgcacgcctccactacaaccattggtggcaacccaagctacaaaccctcagcgcatttgaagcaggccgtctgaaaaacagccgccgcgaacattccgacaacaccagccaactgctcagcaactccatcgtgtactaccgcaacgcgcgccaatactgggtagccggtatcgacctctaccgcgaacgcaaccgcgacgacaaaagcgacagcttcaaccgctacgccctgcgcaccacatggggacaagaatggcccaaaggcctctccaccgtcctacgcctcagcgccgcccaacgccgttaccaagcccccggcttcttcagtaacgaacaaaaccgccgcgacaaagaaacctccgcctccctgagcgtatggcaccgcgccctccatttcaaaggcatcaccccgcgcctgaccattgcccacaacaaaacatggagcaacgacaagttctacgaatacggcaaaaccaaaatgtttgtcgaattgagcaaaacgttctga

SEQ ID NO: 428 - protein, 518 aa, N. subflava
MALGLQNFRLKTLYNLPTYTDNIPNIAMKKRLLLLAILPLSLYAADVPPNVKPELQVNTAEPQQPEAHNIPAEQTNRPSEKIIDVDADTLLANTELLARAMYSAVVAHNIPGIKAVLPIYEQWPEHDRAMARYAKGLLAQSEGRAAEAVGHYRRFIAEQPDASAVRWQLATALFEDKQNEAAADQFDKLQTESLPPALQERIETYRKALRERDLWQFNAGLNITREQNINQAPSQRRLGNHLSDEQCRAVRLVYPDDDCFRGWTFPEPIDATAVHYQIGAEKKWSLPRGFYVTAGADHYGKIYPKHTNYNDLTTRFSAGLGYADQRSDIGITPFHERRFYGNDPYTYTNGARLHYNHWWQPKLQTLSAFEAGRLKNSRREHSDNTSQLLSNSIVYYRNARQYWVAGIDLYRERNRDDKSDSFNRYALRTTWGQEWPKGLSTVLRLSAAQRRYQAPGFFSNEQNRRDKETSASLSVWHRALHFKGITPRLTIAHNKTWSNDKFYEYGKTKMFVELSKTF

SEQ ID NO: 429 - DNA, 1467 bp, N. subflava
atgaaacgccttttgctccttcccttttttatcagcttgctgccccacgcgtttgccgacgacagggaagaccgcttcatgcagctcaaacagggaacggaactccgccgcgctcagcaggaaaggaacgaagcggacaatacggtgattgagttcggtgcgggagaagtgcaggacggcgaagatttggcgttgtcgctgatgaaggcggtcaacgcgcaaaacgaggaagaaacggcacggctgttggacatttaccgccgtcaggatgattacgaccccgatatagtgctgtttgccgaggccaatcaggcggtgttctgcgacgatttgaaggccgcgctggcgaaataccgcgagctttaccgcaaaaatcccgaatttctgcgcggccgcctggatttggcgcggctgctgtttatagacaaacaaaacaaagaatcagcggcattgttcgacggcatcgatattcctgaagtacccgccgtcaatgagaaaatcaaagtgtttgccgacgctttgaagaaacgcgatgcgtggagcggctcggtttcgttcggcgcgggttatgacaccaacttaaaccagtcgtcgggagcgacggtcgtccgcaatcagacaagctgcggtttcgattcgaacgggcagccgattctggacggcgacggaatgctgtcctgccgcaacgaacggcttgatgcctacgcgcccgatgcgttgaaaaaccggatgtgggtatatgaagccaacttaagcagacgcatttcgctcaacggccaccacggcctgcaactgggcggctacacatggggccggctctatcccggcaacagagaatacagcgaacacaatatcaacgtcagccccgcttacagttttcagagcaaagaccattccttcagtatcggcccgcaggtgcaatacgaatggtctggcggcaaactgcgcgacagcagcgccggcatcagcacggcatacagccgcaccttttccgaccaagcctcgctgggcgtgcagctcgaccacaaatacgaccgctaccgcggcgaattaaaacatttcaacggcccacagacgcttctgttcaccaccgccatctacgccctgccgaaagactggctggtattcggcggctacgactacctgcgcaaaaacagccgcgaaaaagtggattcctaccgtcggcacggcctgcgcacgggtgtcaataagcgttttgaatccggcatcgacgccacctttcaggcaatctggcgcaaaacagcctatcaggactaccatgcctggctggaaacccgccgccgtgatttcgaacgcacctaccagttggacatcaaattcgaccgccctttcctccgcagcttcgtacctgtccttaccgtaaaacacaccgaaaacaaaagctcgtcctggctaaatcgttataaacggaatgaatttctaattaaaatagaacataggttttga

SEQ ID NO: 430 - protein, 488 aa, N. subflava
MKRLLLLPFFISLLPHAFADDREDRFMQLKQGTELRRAQQERNEADNTVIEFGAGEVQDGEDLALSLMKAVNAQNEEETARLLDIYRRQDDYDPDIVLFAEANQAVFCDDLKAALAKYRELYRKNPEFLRGRLDLARLLFIDKQNKESAALFDGIDIPEVPAVNEKIKVFADALKKRDAWSGSVSFGAGYDTNLNQSSGATVVRNQTSCGFDSNGQPILDGDGMLSCRNERLDAYAPDALKNRMWVYEANLSRRISLNGHHGLQLGGYTWGRLYPGNREYSEHNINVSPAYSFQSKDHSFSIGPQVQYEWSGGKLRDSSAGISTAYSRTFSDQASLGVQLDHKYDRYRGELKHFNGPQTLLFTTAIYALPKDWLVFGGYDYLRKNSREKVDSYRRHGLRTGVNKRFESGIDATFQAIWRKTAYQDYHAWLETRRRDFERTYQLDIKFDRPFLRSFVPVLTVKHTENKSSSWLNRYKRNEFLIKIEHRF

SEQ ID NO: 431 - DNA, 1278 bp, N. wadsworthii
atgaaacgtgcagtcttgttattgagtttatttgcttcgttttgcggagttgtcgccgctgatggcgaagtacagcccgcttcggacttgccttaccgccagatagaagttgcgccgcttcccgatagcgagctgaaatcagagctggaagccgcgcttgccaaacaagattggcaaaatatgcccgagttgctgaaacaataccgcagccgctttctggctgatcaagtattcgctgattatgcagaagcccgctggcgcagcagtcaaggcgaatatatgcaggcgcaagccttataccgtcgcgtgttggcgcaacgccctgattggcaggaagcgcgtgcggctacaatccacaacctttctgccgcacgctccgcaccgcgtgccggtgatttcggcaagcgtttgcaagcatccgatgtttggcagcttcctgtcaacctgagccatgtccgcaataatcaagggtatattccgcgcgatcaaaaaacactacttgccggtaaccgttatccggacaaaaataatgatgctttgcgctacaatctgggcgccgagcatgatttcagtctgaaaggcaatcaccgcctgaggctcggactcaccagcggcggtacgcactattgggattattacgaccgcagcacccgttccgtccgcctggctgcgggctaccgcagcagcgcaggtaaacaaagttggtcgtttacaccatacaccgaacaaagctggctgggcagcgaaaaatacacactcaacaccggcgcttctgcggcatacaataataaattcaatgataactggcgcgtgtcgctttccgcttccagtgttaaccgcagttacaacaatcccgatcatgcaaaatattatgatggcaacatcaacagcgtatccggtactgccgaatggcgccccaatagcgcatgggcaatcagcgcaggtgcggattatcgggccgatctcacgcgtaacgaaacacgctcgtccgaccgaacggtctttcgcaccggcatctcgcgccagtttgaaggcggcattaaagcaggtgcttccgttcagtatggccggcgtgaattcagccattcggagccgctgtacggcatcggcaggaaagacaatgaatacaatgccagcgcctcgctctcttaccagccgcggcgttggaaaggcgtagcgcctaaaatcgattaccgctattccaaaatcgacagcaatgtggattcttcgtctcgtgagcaatcgcaatggtttatgagtttggaaaaaaaattttaa

SEQ ID NO: 432 - protein, 425 aa, N. wadsworthii
MKRAVLLLSLFASFCGVVAADGEVQPASDLPYRQIEVAPLPDSELKSELEAALAKQDWQNMPELLKQYRSRFLADQVFADYAEARWRSSQGEYMQAQALYRRVLAQRPDWQEARAATIHNLSAARSAPRAGDFGKRLQASDVWQLPVNLSHVRNNQGYIPRDQKTLLAGNRYPDKNNDALRYNLGAEHDFSLKGNHRLRLGLTSGGTHYWDYYDRSTRSVRLAAGYRSSAGKQSWSFTPYTEQSWLGSEKYTLNTGASAAYNNKFNDNWRVSLSASSVNRSYNNPDHAKYYDGNINSVSGTAEWRPNSAWAISAGADYRADLTRNETRSSDRTVFRTGISRQFEGGIKAGASVQYGRREFSHSEPLYGIGRKDNEYNASASLSYQPRRWKGVAPKIDYRYSKIDSNVDSSSREQSQWFMSLEKKF

SEQ ID NO: 433 - DNA, 900 bp, N. wadsworthii
ttggaaaatcgacaaaaatggcaagactctgtttctagaggtttaatatggagcagcaatataaacgaaggctcagacggtccggagtgcctgcatattgaagaattaggcgacatttgggagcattgtcaaaacggcgaaccatcggaaaaagcgcttggcatcaattatgaagccgccgcttcccgccgctttcaaatcagcggacaccacggcttgaacacccgcatactggcatacggcaaaatctaccgaaaccatcaaaaatacaatgaacacacgctcaatgtaagcgcaggctaccaatttgccaacgccaagcgcacagtcactttggcgcctttgtgggaatggagcagcagcggccaacatgcacaacaccgcgcttacggcgcccgcgcagaatggaacgaagcccgcagccgctggtcgtggaacaccgaagccgaatggaaaaagcaggtctatttcaacagcgacatgaaacacaataaccaccgcctgttttccgtgttcaacactttgtcatacggcttgcgggatgatgttgtaatcttcggcggtttggactggcagcagcgcttttccgaagaaccgaccgaaagctaccgccaacccgctatccggctgggagcggcaaaacaatttgccggcggcttcgacgcctcgctctacaccctgctccgccaccgctcctacaaacaagaaaatgaattcttaggcaaacggcgcagggataacgaacaaatctacaccttaaacctcggctccgaccgctggaaaatagccgatatgaaacctgtattcacactcaaacaccgccgcgttaatagcaatatcaaatggttaaacagtttcaaacaaaatgaaatcggcatttctctaataaagcagttttaa

SEQ ID NO: 434 - protein, 299 aa, N. wadsworthii
MENRQKWQDSVSRGLIWSSNINEGSDGPECLHIEELGDIWEHCQNGEPSEKALGINYEAAASRRFQISGHHGLNTRILAYGKIYRNHQKYNEHTLNVSAGYQFANAKRTVTLAPLWEWSSSGQHAQHRAYGARAEWNEARSRWSWNTEAEWKKQVYFNSDMKHNNHRLFSVFNTLSYGLRDDVVIFGGLDWQQRFSEEPTESYRQPAIRLGAAKQFAGGFDASLYTLLRHRSYKQENEFLGKRRRDNEQIYTLNLGSDRWKIADMKPVFTLKHRRVNSNIKWLNSFKQNEIGISLIKQF

SEQ ID NO: 435 - DNA, 1449 bp, N. weaveri
atgttttcttcatctcttattcgcaaaatagcagtttcggcatcattggccgtatttgctttgcctgtttacgccgaagatgtcaagcctcagcccaaaccggtggaaccggaagggcattttaacgtgacaactccggttaataggcctgcaaacgtaccggaaggcttggaaaaaaagcgggaacaggccagtatcgatattagcgaagaagagctgcttcagcgcccggatttgttgaagcgtgcattaatttcatcagttttgtttagcaatgtggagggcgttaaagtcctgttgccgttatataaacagcttcccgaaaagaaagacgaactgttaatgaagatttcggaagccatgatcgcccgttcggaaggggaatatgaacaggcaatccggcaataccgcgaagcgttacagcaaaacggagatttgcagtttgcacgtattgctttggctcaagcattgtttgagaatcatgcggataaaagtgcggaagcagaatttcaaaaaatcaagcagttgccggatgcacccaagcaaattgtcaatatggccgacaactatttgaaagctttggacgaacgcaagagctggcaatttaatgtcgatgcgaattatgtgcgtgataacaacatcaataatgcaacagggaagaggcagatcaaagacggcaaaggcacttggactttgccgaaagcagaatccgcacaaggtatcgcttacaatgtcggcgccagtaaaaattggcgtttggccgataattatgcattaagaaccgagctagacggttacggcaaattttattgggacaatcataaatatgatgatttgaccgtccgcgccggaattggcggtgtgtaccaaactgcacgtttggaagcgtctttacagcctttttttgaaagacgttggtacggcaccgaaaaatactccaaagaaaaaggtttgcgtgcggctgcacagtattgggtaacgcccaagcataaaatgtatgtagcggcggaagccggtgatcagcgtcatgaaagacggaagcatctagacggtaaaaactatacggcatcagccacttggctgtttgttcccaataaccgccaatattggacattaggtgcggattgggcgcgcaaagaagctaaagaccgctcggatgcttaccgacgcagcggtgcccgagtgggttggacgcagcagtggcagaagcatttaaccacatctatgtcgcttggatatgccgttcgcaattatgaagcagcagatatttttcaagtggtccgtaaagacaaagaatattccgccagtttggctgtttcccataaacgtttgagttttaaaggtgtaacgccgaagttggttggcgtatggcaaaaaaccaagagcaaccatccgttttacggtcatgagaaaagcaatgtttatattcagttgaataaaaacttctaa

SEQ ID NO: 436 - protein, 482 aa, N. weaveri
MFSSSLIRKIAVSASLAVFALPVYAEDVKPQPKPVEPEGHFNVTTPVNRPANVPEGLEKKREQASIDISEEELLQRPDLLKRALISSVLFSNVEGVKVLLPLYKQLPEKKDELLMKISEAMIARSEGEYEQAIRQYREALQQNGDLQFARIALAQALFENHADKSAEAEFQKIKQLPDAPKQIVNMADNYLKALDERKSWQFNVDANYVRDNNINNATGKRQIKDGKGTWTLPKAESAQGIAYNVGASKNWRLADNYALRTELDGYGKFYWDNHKYDDLTVRAGIGGVYQTARLEASLQPFFERRWYGTEKYSKEKGLRAAAQYWVTPKHKMYVAAEAGDQRHERRKHLDGKNYTASATWLFVPNNRQYWTLGADWARKEAKDRSDAYRRSGARVGWTQQWQKHLTTSMSLGYAVRNYEAADIFQVVRKDKEYSASLAVSHKRLSFKGVTPKLVGVWQKTKSNHPFYGHEKSNVYIQLNKNF

SEQ ID NO: 437 - DNA, 1539 bp, N. weaveri
atgcacaccaacacacaccgttcaggccgtctgaaaaccagcaaagctggtttcgctaaaacgagctttgcgagtttcgccaaaatcggcaaagccggcttcactaaaacgggtttcaccactgccttgttgctgttcacatgcaccacaacggcacaaacactcacgcctgaacaaaaacccgaacccgtccaacccgaactgcccgaactggcatccgatcagcccgtatggcaacccgccgaagcagcctccgcgcccatacaggatatcgacgaagccactttgctcgcccgaccgcaactgctcaacctgctgctggataaaagcgtattgcgaaacgactttgacggcatcggcgtattactgcccgtttaccgcaaactgccctcaagcaaccgcgaccccatccttttgcaattggccgaaagcaaactggccatgcaccaaggccgcttcggtgaagccgtagccgggctccgcaacctgattgccgaaaaacccgagctaaacgtaatccgcatgtatctggcgattgctctcttctacgaccgccaagacctcgccgccaaagaccaatttaccaaacttctcgcccaatccgacctgcccgaaccggaaaaacaagccatcaaccgctttctcgacgaactgcggcaaagccaccgctggcaattcagcggcggagccaactacacctacgaacccaatatcaacaacgcccccatcgtcaaacaacaaggcaatctcgacacccgatcgcaacccgaaagtgcccacggcgtcagctaccgtatcggcgcagaaaaagactgggtgctgccgcacggcttcaccgccaaattcagcaccgacatccacggcaagcactatcccgcacacaaacaatacaacgatctgctggttaacaccgccgccggtatcggctaccgcaacgcccgttttgatgccgaaatcatgccgttcgtttccaaacgctggtggcggggcggcaaagaagaaagcggtctgaaaccgtattccgagagcttcggcgccaccctcggcgtaagtacccgactcgaccgccgctggcggctgaaccaatacgcccgcatcgaaaaaatcaaccacgaacaccgcttccgcttcgacggcatccgccgccaaaccggccacaccctgatttaccaatccaacccgcgccaagcatggttcggcggattggatttccagcgcgaaaccctacacgaccccgacaacagcaaccaccaatggacagcatcgctgggctggatacaggaatggcccaaaggcttcagcacccgcacccgcgccgcatggagcaaacaaacctaccacgcccccatgccttggccgattcaaaaaaaccgaaaagaccgagccttgcagctcaacctttccgtatggcaccgcaatatccatttctggggcattaccccgcgcatcacttggcagcatacccgcaacaagagtaacgtgtttctctatgattatcgcaaacagaatatgtttgtagaattttccaaaacattttaa

SEQ ID NO: 438 - protein, 512 aa, N. weaveri
MHTNTHRSGRLKTSKAGFAKTSFASFAKIGKAGFTKTGFTTALLLFTCTTTAQTLTPEQKPEPVQPELPELASDQPVWQPAEAASAPIQDIDEATLLARPQLLNLLLDKSVLRNDFDGIGVLLPVYRKLPSSNRDPILLQLAESKLAMHQGRFGEAVAGLRNLIAEKPELNVIRMYLAIALFYDRQDLAAKDQFTKLLAQSDLPEPEKQAINRFLDELRQSHRWQFSGGANYTYEPNINNAPIVKQQGNLDTRSQPESAHGVSYRIGAEKDWVLPHGFTAKFSTDIHGKHYPAHKQYNDLLVNTAAGIGYRNARFDAEIMPFVSKRWWRGGKEESGLKPYSESFGATLGVSTRLDRRWRLNQYARIEKINHEHRFRFDGIRRQTGHTLIYQSNPRQAWFGGLDFQRETLHDPDNSNHQWTASLGWIQEWPKGFSTRTRAAWSKQTYHAPMPWPIQKNRKDRALQLNLSVWHRNIHFWGITPRITWQHTRNKSNVFLYDYRKQNMFVEFSKTF

SEQ ID NO: 439 - DNA, 1428 bp, N. weaveri
atgctgaaaaaatccatgtatctgtgtctgacggtttcactgcctgccgttgcggcagacgacacggcccaacgcctgtggcagaccacccgtcaggcagtccaaatccaagagcggaaaagtgtcgaagacaacaccctgaacaccggcatggaaagtccgcaagcccgccgtcaagacaccgcacaagaagacaacggcgaagccctgtttatggctgtcaaccgcagcgactggccgcaagtccgccgcctgctcaaccaataccgccaacaagcccattacgatcaggacattgccctatttgccgaagcggcactcaacaaatcagacggccgcatgaaagaagcgcggcaaaaatacgaacaactattgcaacgccaacccgatttcacacgaggccggctcgacttggcacgcctgctgttcgacgaccacctgaaccgcgaatccgcagccgaatttgccaaagccaagcaagaacccctgcccgaacccgtattaaacaatattcaagcttttcagacggccatcgaccgacgccgcagctggcagggttcggtcaatgtcggcggcatttggaacagcaacgtcaaccaaggcagcaacggcatccactgcacccatgaattcgaaggcaaatgtatcggcaactattggacggccgacaaacccgaaaccgccgccggtctcaaatacgaaaccgccgtctcacgccactggcaagtgaaagggcatcacggggtcaatgtccgcgctttggcctacggccgcgtttaccgcaaccaccaaaaacacaacgaacataccgccaacttaagcgcaggctaccaatttaccaacgcccgccgcaccgtcaccgccgcaccgttatgggaatggagtgcagaaggcaaacacgcctcacaccgcgcttacggcctacgtaccgaatgggacgaaaatctcggcaactggtcttggaacactgaagccgaatggaaaaaactcaaatacttcgatgaagaatcggcgcacaacaacggcacgtcgctggccgtatacaacaccgtttcctacagcccccgcgccgactgggccgtcttcggaggcttggattggctgcaacgcaaaacttcagacggccaaggcgattaccgccagccaagcctgcgtttgggcataggcaaacaattcgagcagggttttgacgcttccgcacacgccgttttccaacagcgcacctacaaaagcgaagaccgcattctggaaaaacgccgccgcgaccacgaacaaacctatattctcaacatcggcgcagaacgctggcggtttgccggtatgaaacctacgctgaccttcaaacaccgcagggttaacagcaatatccaatggctgtaccaataccggcaaaacgaagtcggcgtttcgctgatgaaagtgttttaa

SEQ ID NO: 440 - protein, 475 aa, N. weaveri
MLKKSMYLCLTVSLPAVAADDTAQRLWQTTRQAVQIQERKSVEDNTLNTGMESPQARRQDTAQEDNGEALFMAVNRSDWPQVRRLLNQYRQQAHYDQDIALFAEAALNKSDGRMKEARQKYEQLLQRQPDFTRGRLDLARLLFDDHLNRESAAEFAKAKQEPLPEPVLNNIQAFQTAIDRRRSWQGSVNVGGIWNSNVNQGSNGIHCTHEFEGKCIGNYWTADKPETAAGLKYETAVSRHWQVKGHHGVNVRALAYGRVYRNHQKHNEHTANLSAGYQFTNARRTVTAAPLWEWSAEGKHASHRAYGLRTEWDENLGNWSWNTEAEWKKLKYFDEESAHNNGTSLAVYNTVSYSPRADWAVFGGLDWLQRKTSDGQGDYRQPSLRLGIGKQFEQGFDASAHAVFQQRTYKSEDRILEKRRRDHEQTYILNIGAERWRFAGMKPTLTFKHRRVNSNIQWLYQYRQNEVGVSLMKVF

SEQ ID NO: 441 - DNA, 1527 bp, N. weaveri
atgaaaaaaatattattaaccttaataataatcccgatgtcaaatttaactaccgcatcaatcatccatccacccactgatcagcaatcagaacaaatacaacaagagcaatgggttgaaacgttgcaaaaacaatcgcaccaaactacccaagcgcaggaacattctgccaatcaaaccactgtacccaccattaccaatcaagatttaatccaaaatccggaactgctgactgctctaatgcaacaagccatcgataccaagcagcaagacttactgacctctctttctgaagcctacgccatgctgcctgaacaacatcaaaatcctgcgatgcggcaacaagcctcaggaacgctcgcatatctgaaaaaagactataaatccgccattaaaatctataacaacttattacaagaaatccctgaaaatccgcgaatcaggttggatcttgctgccatgcagtttgaagacaagcaatggtcagaatctctcaatcacttcaacaccgttttttcccaaccggaaacccctgaaaatgtaaaatacaatatcgcacggtttcaaaacaccataagaaataccactgcttggcaactaaatgctggactgacccctacccgccaatcaaacatcaacgatgctcccccgaaatactgcataagcaaccgcgtatgttcaacagaaacacctgtttcagcaacaggcctttcctaccacttgggtataagcaagctcatgccgctgaaaacaaaccataacttaatctttcaaagtcatatcaacggaacaagctatttcctggataaaaaatccgaatacgaccatgctttttccagaatccatctgggctggcaatggcaggattaccgacactctttatcgattaagcccttttaccaagcccaatttggcggaagcgacggcttcagcagcaaacctaaaaagtcaaagcgggttctgccttatatgcttaaccatggaataggcgcacagattgcttacacccatacccattccaacaaaatgcaaagtcaatattcattcgagcgatatgctgtagactatagagaagcaaacagagccaaattgaataacggtttgcaagacagctcctatacatccttagcgtatcaaatcacacccgatatgctattaatcggcagctatcaattcaaccgcttcattcccaaacacagacaaatccactctaagcaaaacaacgccgcttataaccgtcatgcattcagcttgggatggatccaacattggaaacataccggcggactcgagagcagtattttttacacccaagccaaacgcaattacaaaggcattgccagcttaagcaacgaatcacaaagaaacaaagaaacaacatggaatatcagcttaagccacaacaaactgtcttataaaggctttaaacccaaattaaactttcaccgctacacggttaacagtaatcaagcatgggcaactcgaaaaaataccaacctatccgttaccgtagaaaaaaacttttaa

SEQ ID NO: 442 - protein, 508 aa, N. weaveri
MKKILLTLIIIPMSNLTTASIIHPPTDQQSEQIQQEQWVETLQKQSHQTTQAQEHSANQTTVPTITNQDLIQNPELLTALMQQAIDTKQQDLLTSLSEAYAMLPEQHQNPAMRQQASGTLAYLKKDYKSAIKIYNNLLQEIPENPRIRLDLAAMQFEDKQWSESLNHFNTVFSQPETPENVKYNIARFQNTIRNTTAWQLNAGLTPTRQSNINDAPPKYCISNRVCSTETPVSATGLSYHLGISKLMPLKTNHNLIFQSHINGTSYFLDKKSEYDHAFSRIHLGWQWQDYRHSLSIKPFYQAQFGGSDGFSSKPKKSKRVLPYMLNHGIGAQIAYTHTHSNKMQSQYSFERYAVDYREANRAKLNNGLQDSSYTSLAYQITPDMLLIGSYQFNRFIPKHRQIHSKQNNAAYNRHAFSLGWIQHWKHTGGLESSIFYTQAKRNYKGIASLSNESQRNKETTWNISLSHNKLSYKGFKPKLNFHRYTVNSNQAWATRKNTNLSVTVEKNF

SEQ ID NO: 443 - DNA, 1515 bp, Neisseria sp GTA CT1
atgcccgaaagcaccaaaatgcccgatatggtttcgcctcaaataaaaaacgcagattcatgcaccattgcaacccaaacgtcttacgaaaacatgaaaacactcttactcctctccctgctcgccgtgtccgcagcggaagccgccgacgtgccacccgagcctcaaaaccagcctgcccccgagttgcaggtcaaaacggcagaacctgcccctgtcgaagaagcagcggccaaacctgccgccgaaacgtcgtctgaaaaagtcgtcaacgtcgatgccaaaaccctgctcgacaatccccaattgctttcccgcgccatgtattccgccgttgtgtcgcgcaacatcgcgggcatcaaagtcgtcctgccgatttacgaacaatggcagggacacgataaaaacatggcgctctacgcgcacggattggttgcccaagacgaaggcaaaatgaaagaagccatcgggtattaccgtcaatttatcgctgaaaaccccgatgcccccgtcgtccgctggcagcttgccactgctttgtttgaagacaagcaaaacgaagccgccgccgaccagttcgacaaactcaaaacagaagccaacctgcccgagccgctcgtcaaaggcatcgaatcctaccgtaaagcattgcgcgagcgcgattcgtggaaattcaacgccggtttgagcgttacccgcgaacaaaacatcaaccaagcccccagccgccgcacatacggcaactggaccttccctgagcctatcgacgccaccgccatcaactaccaactcggcgcagagaaaaaatggtcgctgcccaaaggctggtacgttacggcaggcgcggacaattacggcaaaatttatcccgaacaaaccaagtataacgacgtaaccacccgcttctcagtaggcgcaggctatgccgaccagcgcaacgacatcggcttgaccccgttccacgaacgccgcttctacggcaacgacccgtacacctactccagcggtgcgcgcctgcacatcaaccgctggtggcagcctaagctgcaaaccttgagcgccgttgaaatgggtcgtctgaaaaacacccgccgcgcccgttccgacagcaacaaccgcctgctgagcaattccgtcgtctattaccgaaacgcccgccaatactgggtcggcggttttgacatctatcaggaacgcaataaagaagacaaatcggacagcttcgaccgttacagcctccgtaccgcatgggggcaggaatggggcaaagggctgtccaccatgttgcggctgagtgcggcgcaacgccgttatcaaacgcccagccttttgagcggtcaggaaaaccgccgcgataaagaagcggatatttcgctcgccgtgtggcaccgcgctttccacttcaaaggcatcaccccgcgcctgaccgtcgcccaccacaaaacatggagcaacgacaaatattacgaatacggcaaaaccagaatgtttgtcgaattcagcaaaacgttctga

SEQ ID NO: 444 - protein, 504 aa, Neisseria sp GTA CT1
MPESTKMPDMVSPQIKNADSCTIATQTSYENMKTLLLLSLLAVSAAEAADVPPEPQNQPAPELQVKTAEPAPVEEAAAKPAAETSSEKVVNVDAKTLLDNPQLLSRAMYSAVVSRNIAGIKVVLPIYEQWQGHDKNMALYAHGLVAQDEGKMKEAIGYYRQFIAENPDAPVVRWQLATALFEDKQNEAAADQFDKLKTEANLPEPLVKGIESYRKALRERDSWKFNAGLSVTREQNINQAPSRRTYGNWTFPEPIDATAINYQLGAEKKWSLPKGWYVTAGADNYGKIYPEQTKYNDVTTRFSVGAGYADQRNDIGLTPFHERRFYGNDPYTYSSGARLHINRWWQPKLQTLSAVEMGRLKNTRRARSDSNNRLLSNSVVYYRNARQYWVGGFDIYQERNKEDKSDSFDRYSLRTAWGQEWGKGLSTMLRLSAAQRRYQTPSLLSGQENRRDKEADISLAVWHRAFHFKGITPRLTVAHHKTWSNDKYYEYGKTRMFVEFSKTF

SEQ ID NO: 445 - DNA, 1464 bp, Neisseria sp GTA CT1
atgaaatctaatcaattcatttttattgcgggcatattatttcccataatggttactgccgaaaccattgctaaccctgaaactgaagccgatcgccagatggaaagaatccaagaaatggccattcctaaaccaccggaggtaggtacctcccttttgaaaggtgtcaaggcttctttgaatgagcatactcagacattgacattagatgatctagccaaacaaccagagctgaccgaacctttgttaaatcaagcattgcaagcgcgaaactatattgctgcagagcagctcttgcctatatatcgtaaatgggatatgcatgaccctattttattggattatgcgcaaggcgcaatttggcgttcgcaaggaaagcataaaaaagccattacactttaccgtaatattcttgttcgacatcctaatcttgtcaccgttcgtctagacttggctgctatgctttatgaggataagcaaacccgtaattcacaacatgaatttaatgctgccaaaaagcaaggtttgccagaagatgtccttcctactattgccctttatgaaaacgctatggggcaaaataaatggcaattttcaggcagtctgagttacacccaagacaacaatatcaacaacgtttcagctgagcgtgaaatccatcttcctcaatttgataacttggcttttgaaaaaaattctgactatctgccacaaaaagggcatggttttacctacgccctatccgttgatcgcgatatcaatctcaaaggcaaccattatttcgctctttcaggcgatgtcgacggtgtcagctattgggataatcatgattatgatgatcaaacggcaaaagtcagtcttggttataaaaataaaagttttaaaacagatagttttgttatgccatttttagaaaagcgtcgctacggaaatcatccttattacacgcgtacaggtgtagatttaggtgtttcacgttggataaaaccaaatttacgtctatctgccaacggaacctttgcacaaaaagattatgcctataccaaacaacaagggaaagattatcagattggatttgggacgacctacctgatgaatgataaaacctatttcttaggaggtttgagttatgcgcgtgacaaagttgaaaatttcgcaggcagcagctccaaacggataggaggttacttaggttgggggcaaatttggggtgaaaatttcaatagtcgccttatcatcaatcactacaatgaacgctttgatggaaaacattacgtctttaccgaccgtcatcgtacagataatgtcgtggttaccaatttaagcctctggcacaataaactgagttttctagaaattacgccgagattaaattggcgatatacaaacaataacagcaatattaatgaacttcatggttatacaaaaaatcgtgtatttatagattttgagaaaacgttttga

SEQ ID NO: 446 - protein, 487 aa, Neisseria sp GTA CT1
MKSNQFIFIAGILFPIMVTAETIANPETEADRQMERIQEMAIPKPPEVGTSLLKGVKASLNEHTQTLTLDDLAKQPELTEPLLNQALQARNYIAAEQLLPIYRKWDMHDPILLDYAQGAIWRSQGKHKKAITLYRNILVRHPNLVTVRLDLAAMLYEDKQTRNSQHEFNAAKKQGLPEDVLPTIALYENAMGQNKWQFSGSLSYTQDNNINNVSAEREIHLPQFDNLAFEKNSDYLPQKGHGFTYALSVDRDINLKGNHYFALSGDVDGVSYWDNHDYDDQTAKVSLGYKNKSFKTDSFVMPFLEKRRYGNHPYYTRTGVDLGVSRWIKPNLRLSANGTFAQKDYAYTKQQGKDYQIGFGTTYLMNDKTYFLGGLSYARDKVENFAGSSSKRIGGYLGWGQIWGENFNSRLIINHYNERFDGKHYVFTDRHRTDNVVVTNLSLWHNKLSFLEITPRLNWRYTNNNSNINELHGYTKNRVFIDFEKTF

SEQ ID NO: 447 - DNA, 1440 bp, Neisseria sp GTA CT1
atgtacaaaccgtctgcctgccttctcctgtttctcgccgcccccgtccttgccgcgccccgttctgacttttcagacgaccgtaccgcgcaacgcctgtggcaaaacacccgccaaaccatgcaggagcaggaacaaaaagtgcgcgaataccgcctcgacattccctccgaaaacatcgggcagacagccgaaaccgaccccgaagccgaccaaggcgaagccctgtttaacgccgtcaaccgcagcgactggcaaaccgtgcgcccgctgcttgaacgttatacccagcaaaccgaatacgaccccgacatcgccctctttgcccgcgcctcgctcgcccgcggcgaaggcaggtggaaagatgccaaacaagactacgaaaccctgctgcaacgccatcccgacttcacgcgcggacggctcgattacgcccgcctgctctttgaaggtcgtctgaaccgcgaagccacttccgaatttatgcgccttcaaaacgaagacctgcccgaagccgtcaaagaaaacatcggccatttccgcgactctctaaaccaacgccaaagctggcagggcagcctttccgtcggcgccgtccacaacagcaacatcaacgaagccagcggcaaagtgtggtgtaaaaccgaaatagacggcgaatgctgggaagaattttcaggcgaccagcccatttccgccaacggcatcaaatacgaagccgccgccgtccgccgctggcagattaaaggacaccacggcatcgccgcccgcgcgctcggctacggccgcttctaccgcgaccataaagacttcaacgaacacacactcaacctcagcgcaggctatcagtttgaaaaccaccgccacaccttcgccctcgccccgctcgtcgaatggaacggcagcggcggcaaaaccctcaaccgcgcctacggcgtgcgcagcgagtggaacctcgacaaaggcagctggacgtggaataccgaagccgagtggaaatacctttcctattccgacaaaacccgcctactcgacggcagcctcttctccgtttacaacaccctgtcctacttcccgcgcaacgacctcatgctctacggcggcatagactggcagcagcgcaaagccaaagagccggtagacagctaccgcctcatctccgcacggctgggcgcggcaaaaatgtttgaagccggcttcgacgcctccgcctccgccaccttcggcatccgcagccaccgcgaagaaaacgccgtcctcgaacaacgccgccgcgacaaagaacagacctaccgcctcagcataggcgcggaccgctggaaattcgccggcctcaagcccgtcctcagctacaaacaccgccgcgtccacggcaacaccgactggctgtacagctacaagcaaaacgaagtcggtctgtcgctggtgaaatcgttctaa

SEQ ID NO: 448 - protein, 479 aa, Neisseria sp GTA CT1
MYKPSACLLLFLAAPVLAAPRSDFSDDRTAQRLWQNTRQTMQEQEQKVREYRLDIPSENIGQTAETDPEADQGEALFNAVNRSDWQTVRPLLERYTQQTEYDPDIALFARASLARGEGRWKDAKQDYETLLQRHPDFTRGRLDYARLLFEGRLNREATSEFMRLQNEDLPEAVKENIGHFRDSLNQRQSWQGSLSVGAVHNSNINEASGKVWCKTEIDGECWEEFSGDQPISANGIKYEAAAVRRWQIKGHHGIAARALGYGRFYRDHKDFNEHTLNLSAGYQFENHRHTFALAPLVEWNGSGGKTLNRAYGVRSEWNLDKGSWTWNTEAEWKYLSYSDKTRLLDGSLFSVYNTLSYFPRNDLMLYGGIDWQQRKAKEPVDSYRLISARLGAAKMFEAGFDASASATFGIRSHREENAVLEQRRRDKEQTYRLSIGADRWKFAGLKPVLSYKHRRVHGNTDWLYSYKQNEVGLSLVKSF

SEQ ID NO: 449 - DNA, 1467 bp, Neisseria sp GTA CT1
atgaaacgccttttgctccttcctttttttatcagcctgctgccccacgcgtttgccgacgacagggaagaccgcttcatgcagctcaaacagggaacggaactccgccgcgcgcagcaggaaaggaacgaagcggacaatacggcggttgagttcggcgcaggagaagtgcaggacggcgaagatttggcgttgtcgctgatgaaggcggtcaacgcgcaaaacgaagaggaaacggcgcggctgttggacatttaccgccgtcaggatgattccgaccccgatatagtgctgtttgccgaggctaatcaggcagtgttccgcgacgatttgaaggccgcgctggcgaaataccgcgaactttaccgcaaaaatcccgaatttctgcgcggccgcctggatttggcgcggctgctgtttatagacaaacaaaacaaagaatcggcggcattgttcgacggcatcgatattcccgaagtgcccgccgtcaatgagaaaatcaaagtgtttgccgacgctttgaagaaacgcgatgcgtggagcggttcggtttcgttcggcgcgggttacgacaccaacttaaaccagtcgtcgggcgcgacggttgtccgcaatcagacaagctgcggtttcgattcgaacgggcagccgattttggacggcgacggaatgctgtcctgccgcaacgaacagcttgacgcctacgcgcccgatgcgttgaaaaaccggatgtgggtatatgaagccaacttaagcagacgcatatcgctcaacggccaccacggcctgcaactgggcggctacgcatggggtcggctctatcccggcaacaaggaatacggcgaacacaatatcaacgtcagccccgcttacagttttcagagcaaagaccattccttcagtatcggcccgcaggtgcaatacgaatggtcgggcggcaaactgcgcgatagcagtgccggcatcagcacggcatacagccgtaccttttccgaccaagcctcgctgggcgtgcagctcgaccacaaatacgaccgctaccgcggtgaattaaaacatttcaacggcccgcagacgcttctgttcaccaccgccatctacgccctgccgaaagactggctggtattcggcggctacgactacctgcgcaaaaacagccgcgaaaaagtggattcctaccgtaggcacggtctgcgtgcgggtgtcaacaagcgttttgaatccggtatcgacgccacctttcaggcaatctggcgcaaaacagcctatcaggactaccatgcctggctggaaacccgccgccatgatttcgaacgcacctatcagttggacatcaaatttgaccgtccgtcctttcgcggcatcacgcccgttttcagcatcaaacacaccgacaacaaaagctcgtcctggctgaaccgctacaaacgcaacgaatttaccgtcaaagcagaatacaggttttaa

SEQ ID NO: 450 - protein, 488 aa, Neisseria sp GTA CT1
MKRLLLLPFFISLLPHAFADDREDRFMQLKQGTELRRAQQERNEADNTAVEFGAGEVQDGEDLALSLMKAVNAQNEEETARLLDIYRRQDDSDPDIVLFAEANQAVFRDDLKAALAKYRELYRKNPEFLRGRLDLARLLFIDKQNKESAALFDGIDIPEVPAVNEKIKVFADALKKRDAWSGSVSFGAGYDTNLNQSSGATVVRNQTSCGFDSNGQPILDGDGMLSCRNEQLDAYAPDALKNRMWVYEANLSRRISLNGHHGLQLGGYAWGRLYPGNKEYGEHNINVSPAYSFQSKDHSFSIGPQVQYEWSGGKLRDSSAGISTAYSRTFSDQASLGVQLDHKYDRYRGELKHFNGPQTLLFTTAIYALPKDWLVFGGYDYLRKNSREKVDSYRRHGLRAGVNKRFESGIDATFQAIWRKTAYQDYHAWLETRRHDFERTYQLDIKFDRPSFRGITPVFSIKHTDNKSSSWLNRYKRNEFTVKAEYRF

SEQ ID NO: 451 - DNA, 1476 bp, Neisseria sp GTA CT1
atgaacaaatcctgcctcctcctgctcgccctgctgcccctgtccgcccacgcagacagtgacgacctgcgccgcctgtccgaagaaaacgggcgcgtgcagcagcaatatcgggaaagcggctggctggacggcggcacacccgcaggcgacatcgaaaacgacgacgcatacatccgtatcggcggtcagatttacaccgtaggcaacaataccgaagagctggaaagcgcgatttatcatgccattaacgaacgtcaatggaaaaaggcagaacgcttcgccacgcgctacgccgccctgcccggccacaatcccgccctacccaaattggtactcggtttaaaacaacgcgccgaaggacgcctcgccgaagccttacggaacctgcaagcggcagaagcactcgaccccgccaacccgcgcatcctgctcgaaaccgcgcgcctttataccgaagacaaccaaaaccgcgaagcccgaagcgcattcgcccgcgcccaagccgccgacatcccagaagaaacccgcgccctgatcggacaatacctcggcgaaatcgacaaacgcagccgctggcacggacaaatcggcatcgcttacggctacaacagcaacatcaaccaatccgacggctccgtccgctgcattctgccgcttgacggccaatgcctcgcctaccaaaacctgcccgaccccatccgttcccccgtatggaattacagcctgagcgcaggcaaaatcacccccattaaaggacaccacagcctcaaaaccaacctcctcgcctacggcacgcactaccgccgcaaagacacagacgccgccctgtccgactacggcagccaaacaggcacactgtctgccggttacgaatacgccgacgcacaaagccgcttctcgctgatgcccgtttacgaacacgaacggcgcaaccgccacacctactacaacgcctacggcgccgaaacctcgtggacgcataccatcaaccccaaatggcaggtcaacgccgactggtcgggcaaacgctaccgccacagcggcaccgcgaaaacctacgccgccgactacaccgaataccgcacaggcttaggcgcagaatacgccctgaccccgaaaaccggcgtgttcgcaggctccgactacacccgccgcacatacaacggcggcacatccgaccaccgcgaatacaccctccgcacaggcttatacaccctgtttgacaacggcacctacctcaacgccctcgttatgaaacggcgcaacctctacgaccgcgcaggcatcgccgcagacggacaaagacgcagcgaccgccaaaccgtctggctcgccgccgcaggcttcagacaatggcacatcggcggcttctaccccgaactgcgcttcaaacacaccaccgtcaaaagcaattccgtgttctaccgctaccgccaaaacgaaatcatgctgggcgtgaagaaacagttttga

SEQ ID NO: 452 - protein, 491 aa, Neisseria sp GTA CT1
MNKSCLLLLALLPLSAHADSDDLRRLSEENGRVQQQYRESGWLDGGTPAGDIENDDAYIRIGGQIYTVGNNTEELESAIYHAINERQWKKAERFATRYAALPGHNPALPKLVLGLKQRAEGRLAEALRNLQAAEALDPANPRILLETARLYTEDNQNREARSAFARAQAADIPEETRALIGQYLGEIDKRSRWHGQIGIAYGYNSNINQSDGSVRCILPLDGQCLAYQNLPDPIRSPVWNYSLSAGKITPIKGHHSLKTNLLAYGTHYRRKDTDAALSDYGSQTGTLSAGYEYADAQSRFSLMPVYEHERRNRHTYYNAYGAETSWTHTINPKWQVNADWSGKRYRHSGTAKTYAADYTEYRTGLGAEYALTPKTGVFAGSDYTRRTYNGGTSDHREYTLRTGLYTLFDNGTYLNALVMKRRNLYDRAGIAADGQRRSDRQTVWLAAAGFRQWHIGGFYPELRFKHTTVKSNSVFYRYRQNEIMLGVKKQF

SEQ ID NO: 453 - DNA, 1416 bp, Neisseria sp. oral taxon 014
atggttactgccgaaaccattgctaaccctgaaactgaagccgatcgccagatggaaagaatccaagaaatggccattcctaaaccaccggaggtaggcacctcccttttgaatggtgtcaaggcttctttgaatgagcatactcaaacattgacattagatgatctagccaaacaaccagagctggccgaacctttgttaaatcaagcattgcaagcgcgaaactatattgctgcagagcagctcttgcctatatatcgtaaatgggatgggtatgacccaattttattggattatgcgcaaggcgcaatttggcgttcgcaaggaaaacatcaaaaagccattacactttaccgtaatattcttgttcgacatcctaatcttgttgccgtccgtctagacttagctgctatgctttatgaggataagcaaacccgtaattcacaatatgaatttgatgccgccaaaaagcaaggtttaccagaagatgtccttcctactattgccctttatgaaaacgctatggggcaaaataaatggcaattttcaggcagtctgagttacacccaagacaacaatatcaacaacgtttcagctgagcgtgaaattcatcttcctcagtttggtaacttggcttttgaaaaaaattctgattatctgccacaaaaagggcatggttttacctacgccttatccgttgatcgagatatcaatcttaaaaacaaccattattttgctctttcaggcgatgtcgatggtgttagctattggaataatcatgattatgatgatcaaacagcaaaggtcagtcttggttataaaaataaaagttttaaaacagatagttttgttatgccatttttagaaaagcgtcgctacggaaatcatccttattacacgcgtacaggtgtagatttaggtgtttcacgttggataaaaccaaatttacgtctatctgccaacggaacctttgcacaaaaagattatgcatataccaaacgacaagggaaagattatcagattggatttggggcgacctacctgatgaatgataaaacctatttcttaggaggtttgaattatgcgcgtgacaaagttgaaaatttcgcaggcagcagctccaaacggataggaggttacttaggttgggggcaaatttggggtgaaaatttcaatagccgccttatcatcaatcgctacaatgaacgctttgatggaaaacattacgtctttaccgaccgtcatcgtacagataatgcagtagttaccaatttaagcctctggcacaataaactgagttttctaggaattacgccgagattaaattggcgatatgcgaacaataacagcaatattaacgaacttcatagttatactaaaaatcgtgtatttatagattttgagaaaacgttctga

SEQ ID NO: 454 - protein, 471 aa, Neisseria sp. oral taxon 014
MVTAETIANPETEADRQMERIQEMAIPKPPEVGTSLLNGVKASLNEHTQTLTLDDLAKQPELAEPLLNQALQARNYIAAEQLLPIYRKWDGYDPILLDYAQGAIWRSQGKHQKAITLYRNILVRHPNLVAVRLDLAAMLYEDKQTRNSQYEFDAAKKQGLPEDVLPTIALYENAMGQNKWQFSGSLSYTQDNNINNVSAEREIHLPQFGNLAFEKNSDYLPQKGHGFTYALSVDRDINLKNNHYFALSGDVDGVSYWNNHDYDDQTAKVSLGYKNKSFKTDSFVMPFLEKRRYGNHPYYTRTGVDLGVSRWIKPNLRLSANGTFAQKDYAYTKRQGKDYQIGFGATYLMNDKTYFLGGLNYARDKVENFAGSSSKRIGGYLGWGQIWGENFNSRLIINRYNERFDGKHYVFTDRHRTDNAVVTNLSLWHNKLSFLGITPRLNWRYANNNSNINELHSYTKNRVFIDFEKTF

SEQ ID NO: 455 - DNA, 1470 bp, Neisseria sp. oral taxon 014
ctgaaacccgccgaccggaaagccgacaccatgtacaaaccgtctgcctgccttatcctgtttctcaccgcccccgtccttgccgcgccacgttccgacttttcagacaaccgtaccgcgcaacgcctgtggcaggatacccgccaaaccatgcaggaacaggaacaaaaagtgcgcgaataccgcctcgacattccagccgaaaacatcgggcagacagccgaaaccgaccccgaagccgaccaaggcgaagccctgtttaacgcagttaaccgcagcgactggcaaaccgtgcgctccctgctcgacagctatacccgacaaaccgaatacgaccccgacatcgccctctttgcccgcgcctcgcttgcccgcggcgaaggcaggtggaaagccgccaaacaagactacgaaaccctgctgcaacgccatcccgacttcacgcgcggacggctcgattacgcccgcctgctctttgagggccgtctgaaccgcgaagccgccgccgagttcgcccgcctccaaaacgaagacctgcccgaagccgtcaaagaaaacatcgcccatttccaagatgctctgaaccaacgccaaagttggcagggcagcctttccgtcggcgccgtccacaacagcaacatcaacgaaggcagcggcaaagtttggtgcaaaaccgaaatcgccggcgaatgctgggaagaattttcaggcgacaagcccatttccgccaacggcatcaaatacgaagccgccgctgtccgccgctggcagattaaaggacatcacggcatcgccgcccgcgcgctcggctacggccgcttctaccgcgaccatcgggacttcaacgaacacacgctcaacctcagcgcaggttaccagtttgaaaaccaccgccacaccttcgccctcgccccgcttgtcgaatggaacggcagcggcggcaaaaccctcaaccgcgcctacggcgtacgcagcgaatggaacctcgaccgtgaaagctggacatggaacaccgaagccgagtggaaacacctctcctattccgacaaaacccgtctgctcgacggcagtctcttctccgtttacaacaccctgtcctatttcccgcgtaacgacctcatgctctacggcggcatagactggcagcagcgcaaagccaaagaccatgtggacagttaccgccaaatctccgcacggctgggtgccgcaaaaatctttgaagccggcttcgatgcctcactctccgccaccttcggcctgcgcagccaccgtgaagagaacgccgtactcgaacaacgccgccgcgacaaagaacagacctacttcctcagcataggtgcagaccgctggaaagccgccggcctcaaacccgtcctcagctacaaacaccgccgcgtcagcggcaacaccgactggctatacagctacaagcaaaacgaaataggcctgtcgctggtgaaatcgttttaa

SEQ ID NO: 456 - protein, 489 aa, Neisseria sp. oral taxon 014
MKPADRKADTMYKPSACLILFLTAPVLAAPRSDFSDNRTAQRLWQDTRQTMQEQEQKVREYRLDIPAENIGQTAETDPEADQGEALFNAVNRSDWQTVRSLLDSYTRQTEYDPDIALFARASLARGEGRWKAAKQDYETLLQRHPDFTRGRLDYARLLFEGRLNREAAAEFARLQNEDLPEAVKENIAHFQDALNQRQSWQGSLSVGAVHNSNINEGSGKVWCKTEIAGECWEEFSGDKPISANGIKYEAAAVRRWQIKGHHGIAARALGYGRFYRDHRDFNEHTLNLSAGYQFENHRHTFALAPLVEWNGSGGKTLNRAYGVRSEWNLDRESWTWNTEAEWKHLSYSDKTRLLDGSLFSVYNTLSYFPRNDLMLYGGIDWQQRKAKDHVDSYRQISARLGAAKIFEAGFDASLSATFGLRSHREENAVLEQRRRDKEQTYFLSIGADRWKAAGLKPVLSYKHRRVSGNTDWLYSYKQNEIGLSLVKSF

SEQ ID NO: 457 - DNA, 1230 bp, Neisseria sp. oral taxon 014
ttggaggaacgaatcaaccgcgccgttatccggcaggattgggacgctttgacggacttgttggcgcaataccgcacccgtcccgaccgcgaccaaatcctgtacgattacgcactgggcgcgctgcgccgttcgcagttgcgtcatgacgaagcggtggcgctctatcgcggcatcgtgctgcggcagcccgatttggcgtatccgcgtttcgatttgggcgtgatgttgtttgaaaacaaacaataccgcgaagcggcggcggaactggaacgcgccaagccggatttgcaacccgacatgcaacagctcgccgaccattacctgaaggccgtcaaagacgcacaaagctggcaacccgaagcctcgctgcaatatgaggcgacggataatgtcaacagtgcttccgctaccgaaatcatcgaatggggcgggcggcagtggcacaaaaccgccgacagcctgccgcaaagcgcgcacggcttccgctacggcttgggcttgtcgcgcgaaatcaatctgggcggccatcatttcgcctacggcaacctcagcggcgacggcgtacattactgggacaatcgggaatttaacgagcaaagcgtcaatctggcggcgggctacaaaaaccgctcgataacgcgctcgttcggcatcgtgccgtttgcagaacaaaactggctcggcggcaaccgctacaaccgctcgttcggtgcccataccgacttctcacgccgtctgaacgcccgatggcgcgtaatgctgaatgcgggatacgtccgaaaacactatcaggaccaccgcatggcggcacgttacgactcaggaatgccgctggcgggcgccacgctgttgtataccgcgccgaaaaactggctgttttacggcggtgcggactggtcgcacgacatcaccaaggaggcggaacaggcatcggtacgcaaaggcgtccggctgggtatggtaaagtttttttcagacggcctcggcctgcgcgcaaacctgcgctacacccgccgcacattcgacgcacccggagagctggtttaccgctttatccgcaaagaccgtgaatatcaggccaatgcctcaatctggcacgacaaaatcgcatggaaaggtttggtaccgcacctgaatatgcgctatctgagaaccgacagcaatatgagcggcttttactcgcgccggaacatgcaatggtttgtcagcgtggaaaagcagttttga

SEQ ID NO: 458 - protein, 409 aa, Neisseria sp. oral taxon 014
MEERINRAVIRQDWDALTDLLAQYRTRPDRDQILYDYALGALRRSQLRHDEAVALYRGIVLRQPDLAYPRFDLGVMLFENKQYREAAAELERAKPDLQPDMQQLADHYLKAVKDAQSWQPEASLQYEATDNVNSASATEIIEWGGRQWHKTADSLPQSAHGFRYGLGLSREINLGGHHFAYGNLSGDGVHYWDNREFNEQSVNLAAGYKNRSITRSFGIVPFAEQNWLGGNRYNRSFGAHTDFSRRLNARWRVMLNAGYVRKHYQDHRMAARYDSGMPLAGATLLYTAPKNWLFYGGADWSHDITKEAEQASVRKGVRLGMVKFFSDGLGLRANLRYTRRTFDAPGELVYRFIRKDREYQANASIWHDKIAWKGLVPHLNMRYLRTDSNMSGFYSRRNMQWFVSVEKQF

SEQ ID NO: 459 - DNA, 1467 bp, Neisseria sp. oral taxon 014
atgaaacgcctgctcatcctgcccgtttttctgagcctgctgccccacgcgtttgccgacgacagggaagaccgcttcatgcagctcaaacagggaacggaactccgccgcgcacagcaggaaaggaacgaagcggacaatacggcgattgagttcggcgcgggagaagtgcaggacggcgaagatttagcgttgtcgctgatgaaggcggtcaacgcgcaaaacgaagaggaaacggcgcggctgttggacatttaccgccgtcaggatgattacgaccccgatatagtgctgtttgccgaggccaatcaggcggtgttccgcgacgatttgaaggccgcgctggcgaaataccgcgagctttaccgcaaaaatcccgaatttctgcgcggccgcctggatttggcgcggctgctgtttatagacaaacaaaacaaagaatcggcggcattgttcgacggcatcgatattcccgaagtgcccgccgtcaatgagaaaatcaaagtgtttgccgacgctttgaagaaacgcgatgcgtggagcggttcggtttcgttcggcgcgggttacgacaccaacttaaaccagtcgtcgggcgcgacggttgtccgcaatcagacaagctgcggtttcgattcgaacgggcagccgattctggacgacgccggaatgctgtcctgccgcaacgaacggcttgacgcctacgcgcccgatgcgttgaaaaaccggatgtgggtatatgaagccaacttaagcagacgcatttcgctcaacggccaccacggcctgcaactgggcggctacgcatggggccggctctatcccggcaacaaggaatacggcgaacacaatatcaacgtcagccccgcttacagttttcagagcaaagaccattccttcagtatcggcccgcaggtgcaatacgaatggtcgggcggcaaactgcgcgacagcagcgctggcatcagcatggcatacagccgcaccttttccgaccaagcctcgctgggcgtgcagctcgaccacaaatacgaccgctaccgcggcgaattaaaacatttcaacggcccgcagacgcttctgttcaccaccgccatctacgccctgccgaaagactggctggtattcggcggctacgactacctgcgcaaaaacagccgcgaaaaagtggattcctaccgccggcacggcctgcgcgcgggtgtcaacaaacgtttcgaatccggcatcgacgccacctttcaggcaatctggcgcaaaacagcctatcaggactaccatgcctggctggaaacccgccgccgtgatttcgaacgcacctaccagttggacatcaaattcgaccgccctttcctccgcggcttcgtacccgtcctcaccgtaaaacacaccgacaacaaaagctcgtcctggctgaaccgctacaagcgcaacgaatacatgtttaaagtggaatacggattctga

SEQ ID NO: 460 - protein, 488 aa, Neisseria sp. oral taxon 014
MKRLLILPVFLSLLPHAFADDREDRFMQLKQGTELRRAQQERNEADNTAIEFGAGEVQDGEDLALSLMKAVNAQNEEETARLLDIYRRQDDYDPDIVLFAEANQAVFRDDLKAALAKYRELYRKNPEFLRGRLDLARLLFIDKQNKESAALFDGIDIPEVPAVNEKIKVFADALKKRDAWSGSVSFGAGYDTNLNQSSGATVVRNQTSCGFDSNGQPILDDAGMLSCRNERLDAYAPDALKNRMWVYEANLSRRISLNGHHGLQLGGYAWGRLYPGNKEYGEHNINVSPAYSFQSKDHSFSIGPQVQYEWSGGKLRDSSAGISMAYSRTFSDQASLGVQLDHKYDRYRGELKHFNGPQTLLFTTAIYALPKDWLVFGGYDYLRKNSREKVDSYRRHGLRAGVNKRFESGIDATFQAIWRKTAYQDYHAWLETRRRDFERTYQLDIKFDRPFLRGFVPVLTVKHTDNKSSSWLNRYKRNEYMFKVEYGF

SEQ ID NO: 461 - DNA, 1482 bp, Neisseria sp. oral taxon 014
ttgtggaaacccgaaatgaaaaaccgcgcctgcctgtttgccctgctgctccccctttccatccccgcctttgccgacgatgacgacacgcgtatgctgcgcgacggggttcagcgtcaaatcaggcagtatcaggaagcggaagcattttcagacggcctttcagatgaaagccgcattaacatcggcggcgagacttatcatgtgccgcacacggaacacgatttggccttgggcatttattacgcggtcaacgacaggcagtggaacaaagtgagggaatttctgacgcactaccgcaccctttccggccacaaaccgcatctggtgctgatggccgaggggttgctggcgcgttcgcagggcgatgtttccggcgcgctggaaaagatgaaagcggcgcaacaggctgcgcccgacgatgtccgcatagggttggaactggcacggctttacggtgaagacaatcagacccgcgaagcaaaagccggtttcgaaaaggttttgcaaggcgggatgccgtctgaaaccaaagagacggtgcaaaactatctcgacatcctcgataaacgcagccgctggcacggcgacatttccgtcgggcgcggttacagcgacaacatcaatcaaggcaacggcaaacgcgaatgcgtgggcgaattgatgggcgaatgtttcagctaccgctccctgcccaagcccgtcggctcggcgttttggcaatacagcgccgccgcctcgaaatccgttccgctcaagggccatcacaacctcatcctgcgcccgattgcctacggcagccgatttgaccgcgccgacacccaaagcgaaccgattgaaaaatacagtgaaaacaccgccctgctgtccgccggctaccaatacgccgatgccgacgatgacctgacgctgaccccgtatttcgaacattactttcgcggcggccgcagccgttaccgcgcatggggcgcggatatgaactgggaacggaatctggggcgaaaatggtcggtcaacgcccgactggaaggcaaacgggtcaaatatctggaaagcgagcgcggatattacagcgactacagcctttatacttccggcgcaggattgggctacacgttttcagacggcctcggcctgttcggcggcatcgacctcacccgccgcaagtatcccgacgcgtttgcccgcagcagggaatacaccgcccgcatcggcggctataaaattttcggcaacggtatctatctcaacgccgccgcccttcaccgcctcagccgctacgacgaaggcagctaccacaccgacggcaaacgccgccgcgacaggcagaccatttttaccaccgctttgggcgcatcgaaatggcagtttaaatacatctctcccgaattaagattcaagcggacggtcagccgcagcaattcggatttttatgtttaccgacagaatgaaatcgcactgaatttgagataccgtttttaa

SEQ ID NO: 462 - protein, 493 aa, Neisseria sp. oral taxon 014
MWKPEMKNRACLFALLLPLSIPAFADDDDTRMLRDGVQRQIRQYQEAEAFSDGLSDESRINIGGETYHVPHTEHDLALGIYYAVNDRQWNKVREFLTHYRTLSGHKPHLVLMAEGLLARSQGDVSGALEKMKAAQQAAPDDVRIGLELARLYGEDNQTREAKAGFEKVLQGGMPSETKETVQNYLDILDKRSRWHGDISVGRGYSDNINQGNGKRECVGELMGECFSYRSLPKPVGSAFWQYSAAASKSVPLKGHHNLILRPIAYGSRFDRADTQSEPIEKYSENTALLSAGYQYADADDDLTLTPYFEHYFRGGRSRYRAWGADMNWERNLGRKWSVNARLEGKRVKYLESERGYYSDYSLYTSGAGLGYTFSDGLGLFGGIDLTRRKYPDAFARSREYTARIGGYKIFGNGIYLNAAALHRLSRYDEGSYHTDGKRRRDRQTIFTTALGASKWQFKYISPELRFKRTVSRSNSDFYVYRQNEIALNLRYRF

SEQ ID NO: 463 - DNA, 1440 bp, Neisseria sp. oral taxon 020
tcagaaggatttgctgatttgcaggtaggcgttggctttgcggtagccgtatagcgggtggttgcttgtggttttctgccacacggtgacgaggcggggggtgacgccccacaggctcaggcgcttgtgccagagggagagggaggcggagtattctttgtcgtcgcggcggatggcgaggaagtcggcggcgtcgtagcggcggccgtagccggcggagagggcggtgccgagtccttttccccagacgcgcacggcggacgcgcggatgccgcgcctgtggtaggcgtcgtcggtgcgggcgcgtttgcgggagaagttggcgccgagggtaaagtattggcgcgggctgtgttggaatatccaggtggcggacaggctgctgttgcggccttcgaggaatttgcgcgtgtcgtagtgctggtagtccgattcggcggcggcagcgaggcggtggcgcgggctgaggctgcgctgccattcggcgcgcaggccggtttcgcgggagtagggttcggtaccgtaccaacggcgctcgtaataggggagcagggcggcttcgctgcggccgctttggtaggcggcgcccagggcggtgcggacggtgagatcgttgtagcggtggttgtcccaataaaatttgccgtagaggtcggtttcgctgcgcaggagcagattgtcggcgaggttgaagtcgcgggcgaggccggcggagtaggagaggccgcgggctttttcgggggcgggcagcgtccattcgccgttgccgtagcgcagggtgtgttcttttgcggcgttgttgacgttgttgtcgcgggtgtagttggcgctcaggcggggcgtccagcggctgcggctgcggatttcgtcgagctggctttgcagggcggcgcgggtttgggggtcgaggtcgggaggagcgagcaggttggtgtagtgcgcttgtgcggagacgttgcggcggtcgtctttcagtgcctgcgccagacggaggcggacgaggaaggcgtcgggcatttggcgtcgggcgttttgcaggcgcctgacggcttcgcggtagcggccgtcgctttgggcggccatgccttcggccgtctcgagcaggacggggtcttgtccttcgggcaggcggcggtagacgggcaggaggagtttgatggcggcggtgttggcggcgatgacggaggaggagagggcgcggtgcagcaggccggggtgttgcagcagttcttcggggttgctgcatgtgagggtgccgccgttttgggaaacgctgctctcgggtgcggatgcgggggcgggcagttcgtcggagccggtgaggtcgaagcgggtgtcgggttggctgagggcggagcgtgcggcggggttcggcaactcgtcggcacgcgctgcggacagggtggcaagcaggagcaggaagggtaggcgtttgggcat

SEQ ID NO: 464 - protein, 479 aa, Neisseria sp. oral taxon 020
MPKRLPFLLLLATLSAARADELPNPAARSALSQPDTRFDLTGSDELPAPASAPESSVSQNGGTLTCSNPEELLQHPGLLHRALSSSVIAANTAAIKLLLPVYRRLPEGQDPVLLETAEGMAAQSDGRYREAVRRLQNARRQMPDAFLVRLRLAQALKDDRRNVSAQAHYTNLLAPPDLDPQTRAALQSQLDEIRSRSRWTPRLSANYTRDNNVNNAAKEHTLRYGNGEWTLPAPEKARGLSYSAGLARDFNLADNLLLRSETDLYGKFYWDNHRYNDLTVRTALGAAYQSGRSEAALLPYYERRWYGTEPYSRETGLRAEWQRSLSPRHRLAAAAESDYQHYDTRKFLEGRNSSLSATWIFQHSPRQYFTLGANFSRKRARTDDAYHRRGIRASAVRVWGKGLGTALSAGYGRRYDAADFLAIRRDDKEYSASLSLWHKRLSLWGVTPRLVTVWQKTTSNHPLYGYRKANAYLQISKSF

SEQ ID NO: 465 - DNA, 1515 bp, Neisseria sp. oral taxon 020
atgtatcggacacacatccgcccgctcagcctttccctcctcctgctgctgacacagcaaaccgccttggccgacgatccgtcagccaaaacaagcatccgcgacgatttcggtattttccgcgacgtgggcggcgatatcggctatcggcagcagcagatcgagcgcaacgacagcctgcgcagaaaaaataccgacggcgcacaggaagacgacacgcctgatttaagcgacgaagatttgaaaaaaaatcccgaaatcgccaaccacatcctgaacaccgccatgctgcgcgaagactgggatacgctggaacacatcatgggtttctaccgcgacattcccggccacgatcccgttatgtacgattttgttcaaggcgcgctttggcgcgctcagggcaagcacggcaaagccatcaaaacctatcgcaaaatcttggacaaacagcccgatttgagctatgtccgcctcgatttggcaggcatgctgtttgaaaaccgcgcctatcgggatgcggcaaaagaattcgggcaggtaaaaaaggaagacatcgaaccggaagccgccgcacaagccgacgcctatttgcaggccgtgaaacaggccaatccgtggcagttcaagctgcgcggcggcctgcaatacagcagcaacaccaacaacgccacctccaacgactacttcctgtggccgtttgccgttatcgacggcgtaacctactactacaaactgccgcgcgatcccgaaagcctgccccgttccggccacggctacagttacggtgcgcaactgcaaaaagactttaacctctcgggcaaccacaacatcggcttcaacatcgaagccgacggcgtgcattatccgggccggcacgaagacaacgaattttccctctcggcagacgcgggctacaaataccaaaacctgaacaacaccttcaccctcaccccgcttgtctccgcctcatggctcggcggcagaccgtacagccgcagcatcggcgcagcggcatcggcaagccgctgggtcacgccccgcctgcaactctcgggctcgtattccgcgctgcgcagaaaataccgcgacgagcgttacgaaggctacgacagcaccgccaacagcctctccctgtcttccgtttacgccctgacgggcaactggtttgttttcggcggcgcagccgtacagcgcgaaaacacccgcgacaaagaagaaacctccacccgccgctcgctcagcctcggcacactctaccgcttcgacaacggtatcaacttccgcatcggcggccgccacgtctcccgccgcttcgccaaccccgccaccctctacggcggcgacatccgccgcgacaaagaaatttatgccgatgcctcggtttggaaagaaaaatggctgcccggcggcatcacacccaagctggaattttcctatctcaaagtcaaaagcaatatctacgccttcccccgcaacaaaaaacaggtattgctgactctggaaaaagaattctga

SEQ ID NO: 466 - protein, 504 aa, Neisseria sp. oral taxon 020
MYRTHIRPLSLSLLLLLTQQTALADDPSAKTSIRDDFGIFRDVGGDIGYRQQQIERNDSLRRKNTDGAQEDDTPDLSDEDLKKNPEIANHILNTAMLREDWDTLEHIMGFYRDIPGHDPVMYDFVQGALWRAQGKHGKAIKTYRKILDKQPDLSYVRLDLAGMLFENRAYRDAAKEFGQVKKEDIEPEAAAQADAYLQAVKQANPWQFKLRGGLQYSSNTNNATSNDYFLWPFAVIDGVTYYYKLPRDPESLPRSGHGYSYGAQLQKDFNLSGNHNIGFNIEADGVHYPGRHEDNEFSLSADAGYKYQNLNNTFTLTPLVSASWLGGRPYSRSIGAAASASRWVTPRLQLSGSYSALRRKYRDERYEGYDSTANSLSLSSVYALTGNWFVFGGAAVQRENTRDKEETSTRRSLSLGTLYRFDNGINFRIGGRHVSRRFANPATLYGGDIRRDKEIYADASVWKEKWLPGGITPKLEFSYLKVKSNIYAFPRNKKQVLLTLEKEF

SEQ ID NO: 467 - DNA, 1458 bp, Neisseria sp. oral taxon 020
atgaaataccgtctgtttctccttccgctgctgcttttgtccctgcccgcccgcgccgacaacgaagacacccgcctgcaactgagatacggcatagaagagcggcagcagcggcaggaaggggaaacggtgggcgatttgtctttcggcgcagccgcgccgcaggaagacgacaatctgccgaccgcgctgatgaaggcggtgaacgcgcaaaacgaaggcgaaacgctgcgcctgctcgaaatctacaaggcgcagcccgatgccgatcccgatatggtgctgtttgccgaagccaatctggccgtattccgcgacgatttgccgggcgcgctggcacgctatcgggagctgtatgcgcgcaatccgcagtttgtccgcgccaagctcgatttggcgcgtttgctgtttgtcgacaagcagaacagggaatcggcggcgctgttcggcagcatcgatattcccgaacgccccgccgtcaacgaaaaaatcaaaggcttctccgacgcgctctccaaacgcgacgcatggagcggctcgctctccgtcggcttgggacacgacagcaatctgaaccgctcctccgctgccaccatgctgcgcgaacagcaaagctgcggcttcgattccaacggacagccgattttggacgccaacggcaatttcacctgccgcagcgaatggctgccgatgaaaacccccgatgcgctaagcggccgcatgtgggcatacgaagccgccgtcagtcgccgcctctcgctcaaaggccaccacggcatacagttttccggctacgcgctgggcaaaatctaccccggaaaccgcgactacaccgaacacagcgtcagcctcagtccggcatacagctttcaaaacaaagacacttcattcagcatcggcccacaaatccaatatgattgggtaggcggcaaaatgcaggacagcaatgcgggcgtcagcgtgtcctacaaccgcactttcgccgacaaagcctcgctgggcgtgcagatagagcacaaatacgaccgctaccgcagcggctacgaacatttcaacggcccgcaatcgttgctgtttgccaccggcgtgtacgttttgccgaaaaattgggtgctctttggcggctacgatttcctgcgcaaaaacagccgcgaaaaagtcgattcctaccgccgccacggcctgcgcggcggtatcagcaaacgctttgattcgggcatcgaagccacattccaaaccatttggcgcaaaaccgcctatcaggacttccatgcctggctggacacgcggcgcaaagacagcgaacgcacctaccaacttgacctcaaactcaaccgccccgccctgcgcggcttcgttcccatcctcagcctgaagcacaccgacaaccgcagcacctcgtgggtcaaccgctacaaacgcaacgaaatcaccttcaagctgcaatacgggttttga

SEQ ID NO: 468 - protein, 485 aa, Neisseria sp. oral taxon 020
MKYRLFLLPLLLLSLPARADNEDTRLQLRYGIEERQQRQEGETVGDLSFGAAAPQEDDNLPTALMKAVNAQNEGETLRLLEIYKAQPDADPDMVLFAEANLAVFRDDLPGALARYRELYARNPQFVRAKLDLARLLFVDKQNRESAALFGSIDIPERPAVNEKIKGFSDALSKRDAWSGSLSVGLGHDSNLNRSSAATMLREQQSCGFDSNGQPILDANGNFTCRSEWLPMKTPDALSGRMWAYEAAVSRRLSLKGHHGIQFSGYALGKIYPGNRDYTEHSVSLSPAYSFQNKDTSFSIGPQIQYDWVGGKMQDSNAGVSVSYNRTFADKASLGVQIEHKYDRYRSGYEHFNGPQSLLFATGVYVLPKNWVLFGGYDFLRKNSREKVDSYRRHGLRGGISKRFDSGIEATFQTIWRKTAYQDFHAWLDTRRKDSERTYQLDLKLNRPALRGFVPILSLKHTDNRSTSWVNRYKRNEITFKLQYGF

SEQ ID NO: 469 - DNA, 1464 bp, Neisseria sp. oral taxon 020
atgaaaaaacaccttctgccgcttatcctgcttgtcctgcccgccgccgcgctggccgacgaagacgacacccgtatgctgctcgacggcgcgcaaaaggaaatgcgccgccaacaggacgcggcggcgttttcagacggcctctccgacagcggcagtatcgaaatcgacggtgaaacctatatcgtgccgcacaccgcccacgatttggaattgggcatttattacgcgatagacgggcggcaatggggcaaggtgcgcgagtttgccgccgcctaccgccgcctgcccgaacacaaaacccatctggcgctgatggccgaaggcttggccgaacgcgccgagggcaaagtcggcgccgctttgaaaaaaatgaaagccgcacacgcagccgcgccggatgatgtgcgcgtcggtttggagctggcgcggctctacggcgaagacaaccaaaaccgcgaatcgcaggcgcagttcaaagaagtattgaaaggagagatgccgtctgaaacccgcgcagccgtgcaaagctatctcgacatcctcgacaaacgccgccgctggcacggcagcatcagcataggcggcggctataacgacaacatcaatcagggcaacggcaagcgcgaatgtgtcggctcgtttatggggcagtgtttcagctaccgccccctgccctcgcccgtcggttcgccgttttggcaatacagcgccgttgccgcgaaaaaaatcccgctgcgcggccaccacaacctgctgctgcgcccgctctcctacggtacgaaataccgccgcgacgacagtcagtcggagccgcccgaaccgtacagcgaaaacaccgccgccctctacgcgggctacgaacacaacaccgccgacagcgatttcacgtttaccccctatttcgaacactactaccgcggcagccgcagccgctaccgcgcatggggcgcggaagccgcgtgggaaaaaaacctcacggccaaatggtcgctcaacgtccgcgccgaagccaagcgggtgaaatacctcgaacaggagcggcagtattacagcgactacaccctctacaccggcggcgcagggctgggctacaccttttcagacggcctcggcctctacggcggcatcgacctcgcccgccgcaaatacccctacgccgcctcgcgcagcaaggaatacaccgcccgcatcggcggctacaaaatgtttaaaaacggcatttatttcaacgccgccgccctctaccgtctcagccactacgacgccggcagctacctcaccgccggcgaaccgcgccgcgaccgccaaaccatcctcaccgccgccctcggcgcatccaaactttcctttaaaagcatctaccccgaattgcgcgtcaaacgcaccgtcggccgcagcaatgccgatctctttgcctacaagcaaaacgaaatcgccctggctttgaaataccggttttaa

SEQ ID NO: 470 - protein, 487 aa, Neisseria sp. oral taxon 020
MKKHLLPLILLVLPAAALADEDDTRMLLDGAQKEMRRQQDAAAFSDGLSDSGSIEIDGETYIVPHTAHDLELGIYYAIDGRQWGKVREFAAAYRRLPEHKTHLALMAEGLAERAEGKVGAALKKMKAAHAAAPDDVRVGLELARLYGEDNQNRESQAQFKEVLKGEMPSETRAAVQSYLDILDKRRRWHGSISIGGGYNDNINQGNGKRECVGSFMGQCFSYRPLPSPVGSPFWQYSAVAAKKIPLRGHHNLLLRPLSYGTKYRRDDSQSEPPEPYSENTAALYAGYEHNTADSDFTFTPYFEHYYRGSRSRYRAWGAEAAWEKNLTAKWSLNVRAEAKRVKYLEQERQYYSDYTLYTGGAGLGYTFSDGLGLYGGIDLARRKYPYAASRSKEYTARIGGYKMFKNGIYFNAAALYRLSHYDAGSYLTAGEPRRDRQTILTAALGASKLSFKSIYPELRVKRTVGRSNADLFAYKQNEIALALKYRF

SEQ ID NO: 471 - DNA, 1311 bp, Novosphingobium sp. AP12
atgctggccggcatcgcggccggtgcgggtgcgcaggatcagggggtcccgcctgcgccggttcccgcgcaaattaaactctcggccgcgcagatctttgcgttggccgagcaagcgggtcgggcaggcgatttcgccaccgccgagaccgcctatcgggccctcacacgggacgccgacctcgaggttcgcaccgaggcccggttccgtctcggcctgatgctggccgacgatctcaagcgctacagcgatgccgcgctcgagtttcgccgtatcctcgacgacaagcccggcgccgcgcgggtgcgcttggaactagcgcgcatgcaagcaatgctcggcaacatggccggcgcccgcaaggaactacgcgcggcgcaggccgcggggcttccttcgtctgtggaacagctggtgcgcttctattcgcgctcgctcaatgcccgcaagccgctgggcggctcgatcgaagtggcgcttgcgccggacagcaacatcaatcgcgccacccgttcggatacgctgggcacggtgatcggcgacttctcgctcgacgacgatgcccgcgccaaatcgggtgtaggcctcgacctgcagggacagggctattttcgccttggcatcgagccggggaccgacctcctggtgcgtgcctcgaccgacgcgacgctctaccgcgagaaggatttcagcgacatcagcttggcgctccaggccgggccgcaatacacttggggcggcaaccagctgaccttctcggcaggcccggcgcgtcgctggtacggcggccgactgttcagcaccaccatggggggcggggtgagttggcagcgaccggtgggcaagcgggggcaggtgcgcctcgacggcaacatcgcccatgtgaccaaccggcgcaatgcgctgcagacggcggatgacttcacgctctccgccagcttcgatcgggctttcagcgcgcgtttcggcggcggcgtgcaggctttcggtttccgcgaagcagcacgcgacccgggttactcgctggcgatgggcggaacgtccgcctaccttttcctcgaactgggtcgcaccacgctggtgggtactgtcggttacagccacctcgaagcggatgcccgcctgttcctctacccgaaccgccgcatcgaagaccgctacagtgccagcatggcagcgactttgcgcgcgttgcacctgggcagcttcgcgccgctggtgcgcctcaagtgggagcgtaaccgttcctcaatcgagatttacgactaccgccgcgtcgtcgccgagttcggcgtcacgtcggcattctga

SEQ ID NO: 472 - protein, 436 aa, Novosphingobium sp. AP12
MLAGIAAGAGAQDQGVPPAPVPAQIKLSAAQIFALAEQAGRAGDFATAETAYRALTRDADLEVRTEARFRLGLMLADDLKRYSDAALEFRRILDDKPGAARVRLELARMQAMLGNMAGARKELRAAQAAGLPSSVEQLVRFYSRSLNARKPLGGSIEVALAPDSNINRATRSDTLGTVIGDFSLDDDARAKSGVGLDLQGQGYFRLGIEPGTDLLVRASTDATLYREKDFSDISLALQAGPQYTWGGNQLTFSAGPARRWYGGRLFSTTMGGGVSWQRPVGKRGQVRLDGNIAHVTNRRNALQTADDFTLSASFDRAFSARFGGGVQAFGFREAARDPGYSLAMGGTSAYLFLELGRTTLVGTVGYSHLEADARLFLYPNRRIEDRYSASMAATLRALHLGSFAPLVRLKWERNRSSIEIYDYRRVVAEFGVTSAF

SEQ ID NO: 473 - DNA, 1356 bp, Novosphingobium sp. PP1Y
atggccggttccggctgttcccctgcggcgtgcgccggcgctgttttggcgctcgctatcgcgggcttttcgccaactgttaaggcacagaccgccgaggcgcagggagcggcacagacggcccggctttccggcacccaattgcttgccttcgccaatcgcgctcgcgatgaggggcgcttcgagattgccgaagcggcctatcgcgcgctgtttgcagatccttcggtacaagtccgcagtgaggcacgattccggttggcgatgctttatgtaggcacgcgtcggctgtcgcaggctgcagtgctgtttcgcgaaatcctcgacgaacagcccgacgcgcagcgggtccgcctcgaactggcgcatgttctggatctcatgggcgatgaggtgggcgcacggcgtgcccttcgcgaagcacaggcgggcaagcttcccccggaagtggcacgcttcgtcgatcgctattccgccgcgctcagggcgcaaaagccccttggtgccagcttcgaccttgccctggcaccggacagcaacatcaaccgtgccacccggtcctcgacgctcggaaccgtgttcggcgatttcgtcctcgacgacgaagcgcgccagcgctcgggtatcgggcttgccctgcgcgggcaggcctatgcgcgtctgccaatcggcgccagcgtaaacttgctcgcaaaactgtccggttccgcggacctctatcgcgcccacgacttcaatgacattgccgttgcagcaacggtcggtcccgaattgcggctgggtgccgatcgcctttccctggatggcggagcgctctggcgctactttggcggccgaccctattcacgcgcggtcacggcagaggcgacgtacctgcatcccctgggccgcaaggcccagctgcgcgccgtggccaacgcggcccttatcgacaatcgccgcaattccttgctcgatggccacagcttttcggcaacgctcggctatgagcgggcgatttcaggccggtccggcgcggggctgaccgtcagcatcgaccggcaggcgacgcgcgatcccggatatgccacctggggctggcaaacatcggccttcgcctatcgcgacctgggcgcgctcaccctcgtcgggacgctgggaatgggcagactgaaggcagatcgcaggatcctgctgtatcccgacaggcgatccgaccgcaattaccgtgccagcctgggagcgacctttcgagcctttcgaattgcaagcttcgcgcctttcatcagagccaccttcgaacggaaccgcagcagcctggaaatccatgactaccgcagattgcgaatggagttcggctttacgcggtccttctag

SEQ ID NO: 474 - protein, 451 aa, Novosphingobium sp. PP1Y
MAGSGCSPAACAGAVLALAIAGFSPTVKAQTAEAQGAAQTARLSGTQLLAFANRARDEGRFEIAEAAYRALFADPSVQVRSEARFRLAMLYVGTRRLSQAAVLFREILDEQPDAQRVRLELAHVLDLMGDEVGARRALREAQAGKLPPEVARFVDRYSAALRAQKPLGASFDLALAPDSNINRATRSSTLGTVFGDFVLDDEARQRSGIGLALRGQAYARLPIGASVNLLAKLSGSADLYRAHDFNDIAVAATVGPELRLGADRLSLDGGALWRYFGGRPYSRAVTAEATYLHPLGRKAQLRAVANAALIDNRRNSLLDGHSFSATLGYERAISGRSGAGLTVSIDRQATRDPGYATWGWQTSAFAYRDLGALTLVGTLGMGRLKADRRILLYPDRRSDRNYRASLGATFRAFRIASFAPFIRATFERNRSSLEIHDYRRLRMEFGFTRSF

SEQ ID NO: 475 - DNA, 1326 bp, Novosphingobium sp. Rr 2-17
gtgattgtctgttttgcggctgcggccgcaccgttcgtgctggcgtccgcggcatcccctgcgacgcccgccaccgcccccaaacgctcacatgaactctcggcaatcgaggtgttcaccgttgctgagcgtgcgcagagtgcaggacactatgaggaagcgatccgtctctatgacgccctgacgcaggaccgcaatgccgacgtgcgggcagaggcccgcttccgcaagggcatgctgttggccagcctgaagcgctatcgcaaggccgcgacggcctttcgcgagctgctcgatgagacacccgatgccgcccccgtgcggctggaactggcccaggtcctggcactgatgggtgacgagggcggcgcccggcgcgagttacgccaagtgcaggcaaccggactgccggaacaagtggcgcgtgcggtcggccagttcgacacggcgctgcgttcgcataagcgcgcgggactaaggctagagttcgcactcgcacccgataccaacatcaatcgggcgaccgaagttcgcacgctggataccgtcatcgcacctttgacgctatcccgcgatgcccgggcccagtcagggctaggcgtccatctgtcggccgacggatacctgaaggtccccatcggtgcagggatcagcgtggtgccccggatcaacagccttgccacgctttatggcaagagcgaattcgacgatataacagtcacggccttggtcgggctggaagtgcagcgtcagcatgaccggttcagcccctcgattggacacggctggcgctggtacggcaagcgttcctacatgcacaccgatgtcgccacgctggactggatccatgtgctgggtcaaacagcgcagttgagcggttcggtaagtgcggccactaccgactatcagctcaataacctacaggacggtgcgctctattccgtgagtgttggtgtcgagcgggcactgtcggcgcgcagcggtgttagcgtcgcgcttaatgccgtgcgccagaccgcacgcgatcccggttatgcgacagcatcgggaggcgtgcgtctgctcggctggcgggaggcgggtcgaaccacactgttcgcctcagcgacgctccagcgtaccgaaggtgacgccgcccttgcgctgttcggcaagcgtcgtcgtgagtggttcgccagcgtacgcgcaggggccaccttgcgggctctgactgtgcacggtttcgccccctacgtgcgggtcggctatgagcgcaatgcatccagcgttgatttgtatgattaccgacgtttcactagcgagttcggcataaccagcgccttctag

SEQ ID NO: 476 - protein, 441 aa, Novosphingobium sp. Rr 2-17
MIVCFAAAAAPFVLASAASPATPATAPKRSHELSAIEVFTVAERAQSAGHYEEAIRLYDALTQDRNADVRAEARFRKGMLLASLKRYRKAATAFRELLDETPDAAPVRLELAQVLALMGDEGGARRELRQVQATGLPEQVARAVGQFDTALRSHKRAGLRLEFALAPDTNINRATEVRTLDTVIAPLTLSRDARAQSGLGVHLSADGYLKVPIGAGISVVPRINSLATLYGKSEFDDITVTALVGLEVQRQHDRFSPSIGHGWRWYGKRSYMHTDVATLDWIHVLGQTAQLSGSVSAATTDYQLNNLQDGALYSVSVGVERALSARSGVSVALNAVRQTARDPGYATASGGVRLLGWREAGRTTLFASATLQRTEGDAALALFGKRRREWFASVRAGATLRALTVHGFAPYVRVGYERNASSVDLYDYRRFTSEFGITSAF

SEQ ID NO: 477 - DNA, 1113 bp, O. batsensis
ttgtggggacaggcgacgatcctgcgccaactcggtcggaccgatcttgcgctgccgctgctggaacggctggtcgcgcgccggccggacgtcgcgcggttccggatcgctcttgccgaagttctggtggacgccgggcagaccgagcgggcgcgcctgcatctggacgaatcccttggcggcatcgcctcggacgtggatcagagccgtgcccggaaactgctgacggcgctggacacgaaaaagaccttcagtggccatttcaacctgtccttcgtgccttcgaccaacgccgcccagcagacgaactcccgtaccgtcaccatcggcggccgcgatttcgtgattgccgacagcgcgcgcaagtcaccggcgatagggctggccctcgacctcggagtgcaggcggtgccgcagatcggtccccgcacgcgtctgcgctttggcctgtccgccgatgcgcgtgtcttcgacgaccgcgcgcgggacgatctgacgctgagagccgaggtcgcgctgcgctatgaacccacaccatcgctcgcgctggaggtcggcacgacctacacgcgccgctggcttgacgggacgggctattcccgcgcgccgggtctctttttcggggtctccgcctatcccgatgcacaaagccggttgcaggtggtggcgagcctcgacgagcttcgacacgagaccgcgacggggctcgacggacagcgctggcttgccgccgtctcctatacccgggcggtcacgccgcaattgcagctgcgggccagtctcggtgccgaacacatgggagcggcggccccgagttctgcctatcgtgcgttttggtcggggatcggcatgagctattactttcggggcgggttgcggctgggcgccgatgcgtcgctgcgccgtgccagctacaacggcgtctcgccgctgttcggcaagcagcgccgcgacacgcagttccgggcctcgatcgaagcctcgcacagccgtttcaacctgtccggatttgcgccggtcatgggggtggactacacccgtcgcgcggcgaacatcaccgtctactcctatgacgagttcagtgcgagggtcggcttgacgaaacggttctga

SEQ ID NO: 478 - protein, 370 aa, O. batsensis
MWGQATILRQLGRTDLALPLLERLVARRPDVARFRIALAEVLVDAGQTERARLHLDESLGGIASDVDQSRARKLLTALDTKKTFSGHFNLSFVPSTNAAQQTNSRTVTIGGRDFVIADSARKSPAIGLALDLGVQAVPQIGPRTRLRFGLSADARVFDDRARDDLTLRAEVALRYEPTPSLALEVGTTYTRRWLDGTGYSRAPGLFFGVSAYPDAQSRLQVVASLDELRHETATGLDGQRWLAAVSYTRAVTPQLQLRASLGAEHMGAAAPSSAYRAFWSGIGMSYYFRGGLRLGADASLRRASYNGVSPLFGKQRRDTQFRASIEASHSRFNLSGFAPVMGVDYTRRAANITVYSYDEFSARVGLTKRF

SEQ ID NO: 479 - DNA, 1020 bp, O. symbiont
ctaaaaactcctctctaatttgagactaatttcattgctgcgtcgactgtatagccagtcaacgttgctgctgacgtccgtatgtttaagggttaaatggggtttgaaaccgaacagtgaccaacgtgaactctttagacttagggtcagatttttctctctgtctttgcgtcgctcgcccaagatgttactgaatttatggtaggtctgttggcgtactgagctagataaggtcgcgctaacggtattgttgaaggttttcgatacccccaatctaatccctatttgacgataggcgtaaggtcgatcttgcgctagccggttcagccaatccgcaccggcaaataccacccagttattattcagcccttgccaagcggtgatgttggtcgaataagaggggccgtcgtaacgttgaaaatggctctttttgtagcgtaattctttgtagtccgcactcactttaaacatgcgctgattagatattttatgcgtccaatcgccgtggagtccccaggcgctaaacagagatttgtcggcgtaggttgaatattcaaatgagggggccaaccgtagctgatcagtgaaattttgaaagcgataacctagttgggtgttgaatgtgctctggtcgtaacccggatgatcatcgtactttttaccgtataacattgattggctatacagggcatgatgtctagcaataggtagcgctttgctagcggtgaattcgtaatctaagccacgggtggagatagccttgggaatgctgcgctggtaaacgcactgtccccgataggttaatagacaagattgattttctgaggattggttgaggttgtctttccagacactgccaatcgcaaaaaatagcgaccagtcactgcgttgctccaatgctttgctaaaactttgcacactgcggtttacccccgcgtgttgcgtgtcatcagtgtctaaatattcggcaatttcagtaaaaatacccctcgcctctttatcttgatgatcttcaaacaa

SEQ ID NO: 480 - protein, 339 aa, O. symbiont
MFEDHQDKEARGIFTEIAEYLDTDDTQHAGVNRSVQSFSKALEQRSDWSLFFAIGSVWKDNLNQSSENQSCLLTYRGQCVYQRSIPKAISTRGLDYEFTASKALPIARHHALYSQSMLYGKKYDDHPGYDQSTFNTQLGYRFQNFTDQLRLAPSFEYSTYADKSLFSAWGLHGDWTHKISNQRMFKVSADYKELRYKKSHFQRYDGPSYSTNITAWQGLNNNWVVFAGADWLNRLAQDRPYAYRQIGIRLGVSKTFNNTVSATLSSSVRQQTYHKFSNILGERRKDREKNLTLSLKSSRWSLFGFKPHLTLKHTDVSSNVDWLYSRRSNEISLKLERSF

SEQ ID NO: 481 - DNA, 1284 bp, Oceanicola sp. S124
atggcgatggtggtgttgttcgggctctctgtcctggcggcgcccccggcccgcgcctcgggatcgcccgtcgaggcggtacaggggctggtccaggccggagagctggagctggcccgtgatcagctgctggcctggcagccgcagtccgccgccgaggccgaacgtcgcctctggcttctggccgtggtctatcgcgaaggcgggcgccccgacctggcgttgatcgtgctggaagacctggtggcccggcgccccgacgtcgcccgcttccggctggagctggccgacaccctggcccgcctgggccagcaggatcgcgcagcctatcactatgacctcgcccgtggaggagagctcagcgacgctcagcgggcccatgcggccagcaatgccacccggatggagacccccagcccctggacgggcaacttcgggatcgcgctggtgccttccagcaaccccggccgcaagacccaggaagagacgctggatctcggcttcggcaccgctgtcctcagccaggaatcgcgggcccagccggcgaccgggctcgaggtcggcgcacggctggcctatgcgcaccggatctcgcagcggcttcagggacaggtggcagtgaacctgaacgggcggctgttcgcggatcgcgacgacaacgatgtgaccggcagcatcgaggcggggctggtgcatcgcctgggcccggatgcgctgttgcgtacgacgctcagttaccagcgccgcgatctcggcggcgatctctattcgcgcgggccgggtttcggggtgaacctgatgctgcgcagcggagcgcgggggcgtatcgggctggggctgaccctgagcgacctgacctatcccggtgccccgggggcggacgggctgcgcagcgtcgccatgctcagctacgatcacgccctttcgccgaccttcggcctgcgcaccctgctgcgctacgagcgcgtcgacgcggtcaacgccgatgtcgccgccaccagctgggaggcggggctgggcgccagccaggtcttccggggcgggctgatcctggacgccgacctgcggctgcgccggtccgggcgtgacggcccgcatgggctgtttggcgtggtgcagcaggaccgtcgccagaccctctcgctgcggttgcgccacagcgaggtctcctggcgcggcttcgccccctatgtcgagctgaccgccgagcggcagcggtcgagcatcccctactacagctacgacgcccaggacctgacgctgggtctgacgcgccggttctga

SEQ ID NO: 482 - protein, 427 aa, Oceanicola sp. S124
MAMVVLFGLSVLAAPPARASGSPVEAVQGLVQAGELELARDQLLAWQPQSAAEAERRLWLLAVVYREGGRPDLALIVLEDLVARRPDVARFRLELADTLARLGQQDRAAYHYDLARGGELSDAQRAHAASNATRMETPSPWTGNFGIALVPSSNPGRKTQEETLDLGFGTAVLSQESRAQPATGLEVGARLAYAHRISQRLQGQVAVNLNGRLFADRDDNDVTGSIEAGLVHRLGPDALLRTTLSYQRRDLGGDLYSRGPGFGVNLMLRSGARGRIGLGLTLSDLTYPGAPGADGLRSVAMLSYDHALSPTFGLRTLLRYERVDAVNADVAATSWEAGLGASQVFRGGLILDADLRLRRSGRDGPHGLFGVVQQDRRQTLSLRLRHSEVSWRGFAPYVELTAERQRSSIPYYSYDAQDLTLGLTRRF

SEQ ID NO: 483 - DNA, 1371 bp, P. aeruginosa
gtgaaccagaaaagccaggccgaacagagcctggcggcgccgcccggcacgctgctctacgaagggcagacctaccaggtgcccgacctgctggaggcgctggaaccggcgatctacatcgtcatcaacagcaaccagtgggtccagctgccggacttcatcgcgcgctatcgtcagttgcccggccaccggccggccctggcggcaatggccgagagcctgatggcgcgcaaccgcggcgactacccgacagccttgcggcgcatgctggaggcccgcgaggaagaaccgcaagacgcgcggatacgcctcgaatccgctcgcctgctgttcgaggacaaccaggacacgcaggccggagaggcgttttcccggttgcagggcacaggactgccgccctatgcggaaatactggtgcaacagtaccggcaagccctggacattcgctccgattggcatggcaccgccgcgctgggctggggctacaacgacaacatcaaccaggccaacggctatcgccgctgcgagtggtacgtaccggtagccgacctgtgtgccttcgaacgggtaatgccggaggccatcggctcggaactgctcaactatgaagcctccctgcagcgtcgcatcaacctggccggcaatcacaacctgcaggtgcgcccggtcagctacggcaactattactcatccaccgacacgtcctcggcctcccgcctccacgactacagcaacagcctgtccgtcctgcaggtcggctaccagtacctggacgcccgcgacagcctgtcactgacgccctacttcgagtactactaccgcaatcgccatggagactatctcgcccacggcctgcaattggagtggcggcgctcgttgaaccagcggtggcagttgggcagcagcctggacgccaagcgctacgaatacagttcccgcgggcaactgacaggcgccgactacaaccagtaccagtgggacctgttcgcgtccttcatgccgcaacccaccaccaacctgtacgcgggggtgaatctcggtcgccggcgctatgcgctagaccaggccagcagcagggactgggcgatccgcggcggactctaccatgcgttcgccggcgaacccggcctgtacgtgaacgcgctgggtatctaccgaaacacccgcaacgaggcgttcgatgccttcctgggcgcgcgccggcatgaccagcagcaggtgtacatcctcggggtcggcgccaacggctggaaattcgccggcctcgtcccggaactacgggttcgccacagcatcaaccgcagcaatctggactgggcgttcggctacaggcagaccgagctcagcctgatgttgcgcaaggacttctga

SEQ ID NO: 484 - protein, 456 aa, P. aeruginosa
MNQKSQAEQSLAAPPGTLLYEGQTYQVPDLLEALEPAIYIVINSNQWVQLPDFIARYRQLPGHRPALAAMAESLMARNRGDYPTALRRMLEAREEEPQDARIRLESARLLFEDNQDTQAGEAFSRLQGTGLPPYAEILVQQYRQALDIRSDWHGTAALGWGYNDNINQANGYRRCEWYVPVADLCAFERVMPEAIGSELLNYEASLQRRINLAGNHNLQVRPVSYGNYYSSTDTSSASRLHDYSNSLSVLQVGYQYLDARDSLSLTPYFEYYYRNRHGDYLAHGLQLEWRRSLNQRWQLGSSLDAKRYEYSSRGQLTGADYNQYQWDLFASFMPQPTTNLYAGVNLGRRRYALDQASSRDWAIRGGLYHAFAGEPGLYVNALGIYRNTRNEAFDAFLGARRHDQQQVYILGVGANGWKFAGLVPELRVRHSINRSNLDWAFGYRQTELSLMLRKDF

SEQ ID NO: 485 - DNA, 1458 bp, P. alcalifaciens
gtgattttgcctacctgtatttttatggaaaaagaacaggaaagagagatgaaaaaaataataaacaatattgaggtattaattctattattgttttctgcaaattcattttctgaaaaaaattatgggtatcaacaatatgaacagataattgaagttttaacggaaataaataacacaaggaataaatcacccattataatcccacttaaaattaataaaactgtcgacgaccttggttttattctttatgatttaaccaatcggcagcagtttcaaaaaatcgatgaactattacctgattatctaaatgataaaaatcacgataaaggtatggtggattatatttcagcagaaagggcttattttaatggtgattacccattgtcacttaagttttatttaaaaatagttaatgaaaaccctaactcagtgttttctgaaatgaaactggctcatgtctatataaaaaatagctatcaccgtgaagcattaagtttatataaaaagataaaagataaatatcgagtaaatctatctgaagagagaataaaacagatagataatgaaattacagcattagaaaatcgcactcattggcagggaaatttcaatgctgatttaaaatatgatacgaactataccgaggctcatggtaatggtgagcagcaatgtagtgcaatgtggtgtatgcaaggtagcgaaattaaatctggtttggtgtatggcttttcaggaaatgccaataaagtcctttggcagaatcgaggacattcactgttggccagccttggtggacatgtatgggaattccctcatcgctcagtaaaaaggcgcttttcaagttattcatcagtaagctatcagtatctttatggtaataaaaaggtcgctttttcaccgattgtagatattaattggcgagggcatctgtttgaccattacagtgttggtgcgcgcattactggggaatattctcccagcagtaaactttatttactgtctaacataacgtataaaaatcaaactttcttcggaaagcgagcatcgcgttcaggttacgatattaattacagtatgacagcaatttatttagttaatccacaatggagcttattctcaaatttatatggtggcaaaaatattgaaaaatataaaagtgatagctatcaattgtcagggttaaccgtggactcaatcaatgtatttggctcgaataagttagtcaataaattaacaagtagcaatcataagttttttgattttgacagtgcacttaatacaaagcgacacgatgagtcatgggcgttaaatagccaaataactctattgggacacaaatttttatcattaacaccaacactctatgttaattacaaattcaatgatagcagtgcaagaataagctattcctataataaaagcgaagtgggtttaaatttaagtaaaacgttttag

SEQ ID NO: 486 - protein, 485 aa, P. alcalifaciens
MILPTCIFMEKEQEREMKKIINNIEVLILLLFSANSFSEKNYGYQQYEQIIEVLTEINNTRNKSPIIIPLKINKTVDDLGFILYDLTNRQQFQKIDELLPDYLNDKNHDKGMVDYISAERAYFNGDYPLSLKFYLKIVNENPNSVFSEMKLAHVYIKNSYHREALSLYKKIKDKYRVNLSEERIKQIDNEITALENRTHWQGNFNADLKYDTNYTEAHGNGEQQCSAMWCMQGSEIKSGLVYGFSGNANKVLWQNRGHSLLASLGGHVWEFPHRSVKRRFSSYSSVSYQYLYGNKKVAFSPIVDINWRGHLFDHYSVGARITGEYSPSSKLYLLSNITYKNQTFFGKRASRSGYDINYSMTAIYLVNPQWSLFSNLYGGKNIEKYKSDSYQLSGLTVDSINVFGSNKLVNKLTSSNHKFFDFDSALNTKRHDESWALNSQITLLGHKFLSLTPTLYVNYKFNDSSARISYSYNKSEVGLNLSKTF

SEQ ID NO: 487 - DNA, 1488 bp, P. asymbiotica
atgttaaatgcccctattagccgttttattttgttaatgagctgtttgtttattcagtcatctctggttctggcagatgaagataccggcagaagattgtggcataacgtacagcgaaatttgcaggatcaagaaaaagcactcgtcactgatgaaatagtcaatcagaatagtgataatttatcgatagtacttaatggtttgacttttagcgtcgaaaataatgtcaatgatattggtcaggcattgtatttggccattaatcatcaacaagttaaggatgttgagcgctttttagcgatgtatcagaagttacctaggcatgatacccaattggtccattttgctcaggcaaatcttgcacgttcacagggtgatttagtgacggcagaacagcattatcaagctatcttgcaccagcaacctgattttacccgcgctaaattagagttagccagggtctattatgaaaatcaaaaaaataaagaggccagcttactgtttaatgaaattgctgcggctaatcacaataacgaaaataaattaccaccggcagtcattaagaatataaccagttatcaggatgccattagtttgcgtaattcatggcgtggatctttttctgtaggctatatttttaacgataacactaatatgtctccgaatcagcctcctgtttgcacccagtattatgaaaatggtagttgcaggacagaacgtaaattgcctttggcgaagaaggcgagtggaatgagttatgatgccacgttgcgtaaggtatattcgttaagtggtcatcatggtatatttctgcgttcgatgacttatggcgaaagttaccatcatcatagtgatgagaatgaaaataccacttctgcttatttgggttataactataaagcgctaaagaatgatttcctgctggggccaattcttgagtttaatcatgttggcaatcgtttccgctatcgtactactggaacgaaagcggaatggatgaatattttatctcaaaatttggcattaaatttagaaggagaatataagcagtttcgttatcataaactttataatcataatgacggtaatatgacttctgtttatgctacgttatcttattatttaacggatcaaacaattacctttgcgggtgtcgattgggttaataaaaccagtgttgaaaaagcggatgattatcagcagaaaggggtaagagcaggtatttctacccaattatatccgggaattaatgcggtggtatttactgctttacgtcagcggcaatttggtgattacagtgtgccactaaatgcacatcgtaaagataatgaacaattctattcggcaattgtcagtatgcctaaatttgaagtgtttggtttaaccccagtgatcacttatcgatacagaaaaaataatagcaatgtcgattggttatattcatatagtaagaatgaggttttagttaagttcgaaaaatatttttga

SEQ ID NO: 488 - protein, 495 aa, P. asymbiotica
MLNAPISRFILLMSCLFIQSSLVLADEDTGRRLWHNVQRNLQDQEKALVTDEIVNQNSDNLSIVLNGLTFSVENNVNDIGQALYLAINHQQVKDVERFLAMYQKLPRHDTQLVHFAQANLARSQGDLVTAEQHYQAILHQQPDFTRAKLELARVYYENQKNKEASLLFNEIAAANHNNENKLPPAVIKNITSYQDAISLRNSWRGSFSVGYIFNDNTNMSPNQPPVCTQYYENGSCRTERKLPLAKKASGMSYDATLRKVYSLSGHHGIFLRSMTYGESYHHHSDENENTTSAYLGYNYKALKNDFLLGPILEFNHVGNRFRYRTTGTKAEWMNILSQNLALNLEGEYKQFRYHKLYNHNDGNMTSVYATLSYYLTDQTITFAGVDWVNKTSVEKADDYQQKGVRAGISTQLYPGINAVVFTALRQRQFGDYSVPLNAHRKDNEQFYSAIVSMPKFEVFGLTPVITYRYRKNNSNVDWLYSYSKNEVLVKFEKYF

SEQ ID NO: 489 - DNA, 1440 bp, P. bettyae
atggactatagatttttatttttattatttttttgtagtggtgcattagctgataatcaagatactgaatttcgtttgcaacaagaagtagagcaacaacaaaaagcacaagaagagcaacttattgaaaaagatcagtttttaacgacaatgatgattaatcatcaagaaattgggattggcaataatattgaagaagtcctcaccgcactttttttagctattaatcataaacaaacagatgatattgagcgtttattagctatttatcaaaccatgcctgaggcagaagaaggaatgattactttcagtttagctaatattgcttttaatcgtggagatactaaaaaagcgattcagctttatgaaaaactggtaaaaacagataatgattttttacgtgggaaacttgatcttgcccgtttatatttttttgattatcaaaataaagaatcccaccaattattttctgaaattaatttatctgagtccccaagtcttatggaaaaagttaatgaatttcagttatctcttgataaccgagaagattggcatggaagtttttccctaggagctatttatcactctaatttgaatcagtctgcgaataagacaactgaatgggttgtgaatacgccattttggggagaaataacgactatcagacattcacctcaagtaatcaaatctcatggtttaggttttgaaggtgcattgaataaatatacggctataaaaaatcatcatggcataatgtttaaaggctctgcaaatggagagttttttcaaaatcatagtttttataatgaacattatttctcactaggcttaggttatcgctataaaaatcaacgtcatcaagttgatatttatcctttatcagaagctagttatactaataatcaatggtattctactcgccaagggattcaagcagaatattcacaagatattggagatgatgcctatttttcttttactttatcttataaaaatgaacgttatcgagaacataatttaaaaatatataatggtaatattgcttctgtttttttatttagtgcttatgcattgcctcatgattgggttatctttggtgggctagattatttacaaaaaaatgggacggaagataaatctgatcaatatgaacgtaaaggattacggttagggattaataaagcttttgatatcggattggatctaactttaagtgtaaattatcgaaaaactgattatcgtcagtatagtgaattattatcagaaaaacgtcatgataaagaatatctttattctgcaaatttaaaattccctaaattgagtttttatggtattactcctcagcttagtctaagtcgaactcaagtaaaatctaatgtagattggttgtataattacaataatcatgaaattgggttatggtttgaaaaacgtttttaa

SEQ ID NO: 490 - protein, 479 aa, P. bettyae
MDYRFLFLLFFCSGALADNQDTEFRLQQEVEQQQKAQEEQLIEKDQFLTTMMINHQEIGIGNNIEEVLTALFLAINHKQTDDIERLLAIYQTMPEAEEGMITFSLANIAFNRGDTKKAIQLYEKLVKTDNDFLRGKLDLARLYFFDYQNKESHQLFSEINLSESPSLMEKVNEFQLSLDNREDWHGSFSLGAIYHSNLNQSANKTTEWVVNTPFWGEITTIRHSPQVIKSHGLGFEGALNKYTAIKNHHGIMFKGSANGEFFQNHSFYNEHYFSLGLGYRYKNQRHQVDIYPLSEASYTNNQWYSTRQGIQAEYSQDIGDDAYFSFTLSYKNERYREHNLKIYNGNIASVFLFSAYALPHDWVIFGGLDYLQKNGTEDKSDQYERKGLRLGINKAFDIGLDLTLSVNYRKTDYRQYSELLSEKRHDKEYLYSANLKFPKLSFYGITPQLSLSRTQVKSNVDWLYNYNNHEIGLWFEKRF

SEQ ID NO: 491 - DNA, 1299 bp, P. bettyae
atgagattttttcttttagggcttattttttgtattagtcagattgcttctgctagcaattcttttttagaagaacaacttaaacaagctatttatcatcaacaacttgataatattcagattttactcaagaactatcaacaggaagtagactcagatttgattcttattgcttatgctcaagcaaaagtagcctatcttctgcaagattatgcaaaagcgatttctatttatcggcaaataattagccaaaaacctcaattaatttcaatgcgaatggaactagccgttgctttatttgtagatcaccaagataatgcagctaaacttcaatttgagagagttaaatcagctctagagttacctaatagtgcttatcagaaagttgaaagctacttggcagcaattaatcggcgtaatgaatggcaagctaactttacgttatcttatttaagaacagacaatgtagaaaatgtatctaacgatttaaacattgaaaatacaggttttattaaaagtaaaaaaatgttgccacaaaaagctcatggttttgcttatagtatagattttggaaaagattttaatttaataaattcccattatattagtattcaaaacgaaacttatggtaagaattactgggataatcacaactttgatgacctttcaactcgaatattattcggttatgcgtataaaaaaatggataatacttttcgtattcagcctttttatgataagcgttggtatggaaatcattcttttcattggtctaatggtattcaattcacttatgatttttatttttctaaacaatggaaaaatcagacaataatgtctttcgaaaatcgatcgttttttaatgaagatttgcaatcaggttatattaaaacattgtctgatactataatttggtataccaatcctcaacagcttttttatttaggtggtgctatttcacaggaaaaaacaaacgatagacagtatggctcaacgagtaaaaatattcgtttgggatggcttcaagaatatcaatggggtatttctagccagctcagtttttcatttacttatcgaaaatttcacgatgaagctatattagcggggattttacctcttaataaaactagacgagactttatttatattctgaatactaaaatttggaaaagagattggtatttttggggcgttaccccaaaactgaatttggtttggaagaaacagaaaagtaatttagacattttatattcttataaagataagcaaataacaattctgtttgaaaaaaccttttag

SEQ ID NO: 492 - protein, 432 aa, P. bettyae
MRFFLLGLIFCISQIASASNSFLEEQLKQAIYHQQLDNIQILLKNYQQEVDSDLILIAYAQAKVAYLLQDYAKAISIYRQIISQKPQLISMRMELAVALFVDHQDNAAKLQFERVKSALELPNSAYQKVESYLAAINRRNEWQANFTLSYLRTDNVENVSNDLNIENTGFIKSKKMLPQKAHGFAYSIDFGKDFNLINSHYISIQNETYGKNYWDNHNFDDLSTRILFGYAYKKMDNTFRIQPFYDKRWYGNHSFHWSNGIQFTYDFYFSKQWKNQTIMSFENRSFFNEDLQSGYIKTLSDTIIWYTNPQQLFYLGGAISQEKTNDRQYGSTSKNIRLGWLQEYQWGISSQLSFSFTYRKFHDEAILAGILPLNKTRRDFIYILNTKIWKRDWYFWGVTPKLNLVWKKQKSNLDILYSYKDKQITILFEKTF

SEQ ID NO: 493 - DNA, 1464 bp, P. bettyae
atgaaaaaggcaatattttgtttattaattgtcttcacaggttcttacagtgcatttacctcggcagtacccggttcagaacccgttcccgaaatacaaggtgcggaagcttataaagcagtagatgacaatgccgatttggaattcatccgcaaacagcaaaaacgcccacaaagacaaattactgtggatgtaccacaggaacatcaaggcatacaaattactgaggcagatttattaatgcagccccagttattacatcaattaatgatggcgttagttcagcggcaaaatgttaccgctttgcgtttgttactgcctatttataaaaaatcagcaaattatgatcacgaacttgccgaatatgtcgaagcgcgtattgctcaagatgacggcaacatgaaattcgctataaaaacttaccgcactttattgactcgtgatcccagcctgtttttagtgcgctttaatttagcgtctgcgctttatctggataaacaatatgcacaagtgcggtccgaattagccgaaattcgtaaagaacaacaattaccacaggattttcttgcttttgctcatgagttggagttagccactgaacagcaaaatacttggtcatgggattttaatttggggtatgtgcaggataaaaatgtcaataatgcacctgatcagcaggaaataaaaacgacaaatggcacttggacattacctaaacccgaatctgcacacggtataagttattttgctacggtaaataaagattggtttttgctgaataattggggctggcgagcgcaaggttatgggtttggtaaatattattgggacaataaaaaatacaatgacatgcaataccgctttagtactggtcctgtatggcagtccgtggatactgaactgaccttcatgccgttttacggtatgcgttattatggtgaacgtgcttatgcggaaaccatcggattacgttccgtactgaattatcacgttaatggaaaatggcgaatttctaccgcacttgaaggtggtaaacgtactcaccccaaacgagaatatctaaatgggcgttatgcacttgggagcttttcactgggttatgctatttcacctcaccaatatcttcatttaagtgtggatactgggtatcgtggtgctcaagatcctagcgatgcttatcatcatcgtggcgtacgtatgggatataccttgttattaccaaagaatatcgtggttaaaacagatgttagctatagtttgcgtcaatatctgggccacaatctatttaatgtggtgcagcggaataaagtttttggtgcatcgtttagtttatggaagaccgattggcaatggaaaggatttatgccgaaatttaatattgattatgagcgtacgtgcagtaattatgttatagcaacctaccataaaaccaatatttaccttgatatttctaaatcattttag

SEQ ID NO: 494 - protein, 487 aa, P. bettyae
MKKAIFCLLIVFTGSYSAFTSAVPGSEPVPEIQGAEAYKAVDDNADLEFIRKQQKRPQRQITVDVPQEHQGIQITEADLLMQPQLLHQLMMALVQRQNVTALRLLLPIYKKSANYDHELAEYVEARIAQDDGNMKFAIKTYRTLLTRDPSLFLVRFNLASALYLDKQYAQVRSELAEIRKEQQLPQDFLAFAHELELATEQQNTWSWDFNLGYVQDKNVNNAPDQQEIKTTNGTWTLPKPESAHGISYFATVNKDWFLLNNWGWRAQGYGFGKYYWDNKKYNDMQYRFSTGPVWQSVDTELTFMPFYGMRYYGERAYAETIGLRSVLNYHVNGKWRISTALEGGKRTHPKREYLNGRYALGSFSLGYAISPHQYLHLSVDTGYRGAQDPSDAYHHRGVRMGYTLLLPKNIVVKTDVSYSLRQYLGHNLFNVVQRNKVFGASFSLWKTDWQWKGFMPKFNIDYERTCSNYVIATYHKTNIYLDISKSF

SEQ ID NO: 495 - DNA, 1446 bp, P. bettyae
atgaaaaagtattatttaatttgtttgttatcttgctattgcacaacaacgtttgctgatatacaggaacaagatgccctacgattgtggaaacaacatattcaacaattaacacagcagcaacgtgaaagtcataccttaaatgtctctcagcctataaatgaaatcattattgagggacaatcttttgaagtagcaccaaatgccttgtcagtgggacaagccctatatattgcgttaaatcaacagctatggcagtacgtagagaagcttttagagcaatataaaacatttgatgagcataaacctgaattaatttggtttgccgaaggtgcactagctcgtgaacgtggtgattttgctttagctgcacaacgctatcatcaattgctgcaagtgcaacctgattttctgagaggacaattagatttagcgagaattttatttgaagataaaaaaaatgcagaatctaccgcacttttccgtaaaatagctgaacaaccgcttcctagcagtgtacttggtaacatacaggattatcagttggcattgaaacaacgtgaaagttggtctagttctctgacatttggttatttgtataataaaaatttaaatcagtcaccacagaaagaacaatgtttattagaaaataaaggtcagtgtctaattaatcgacattcgccaaaagctattaatgctcatggttggcgttatgattttaacacccaacgtcgaatttcattgcgtggccatcatggtttagcattttatttcaatagctatggtcaattttatccgcatgaacatgactataatgaaaacacactaaaaacctatgggggttacagcttccagagtgcaaacacagaaatcaccgttgcaccttttctggaacataatacttttggcaatcaccgtaattatcacagttggggagggcactttgaatggacgcaaaatctttcaccccgtcatttatggaatatgcaatttgagcagaaaagattgcgatatagtgagcattatagcagtttctctaaggcgaatttaagttcattgttcagtacttggtattatttgtattcaccaaaaacaacgttattcggtggggtggattggcaatatcgttacactcctgatcaggcacaagcttatcatttagtaggtacacgcttaggtcttaatcatcaattcgattttggattaaatgcgactgtgatgacattgttacgtcgctataattatcaagggtatcatgcagcattagaggtgacaaggaaggactaccaacagatctatatagcactctttaaaatgcctcaatggagcttaaaaggatttacgcctaatttgttatttaaacatactcgtaatcgcagcaatgctgattatgtttattcctacaaacaaagcgaggtacaactgaattttgaatttcaattttaa

SEQ ID NO: 496 - protein, 481 aa, P. bettyae
MKKYYLICLLSCYCTTTFADIQEQDALRLWKQHIQQLTQQQRESHTLNVSQPINEIIIEGQSFEVAPNALSVGQALYIALNQQLWQYVEKLLEQYKTFDEHKPELIWFAEGALARERGDFALAAQRYHQLLQVQPDFLRGQLDLARILFEDKKNAESTALFRKIAEQPLPSSVLGNIQDYQLALKQRESWSSSLTFGYLYNKNLNQSPQKEQCLLENKGQCLINRHSPKAINAHGWRYDFNTQRRISLRGHHGLAFYFNSYGQFYPHEHDYNENTLKTYGGYSFQSANTEITVAPFLEHNTFGNHRNYHSWGGHFEWTQNLSPRHLWNMQFEQKRLRYSEHYSSFSKANLSSLFSTWYYLYSPKTTLFGGVDWQYRYTPDQAQAYHLVGTRLGLNHQFDFGLNATVMTLLRRYNYQGYHAALEVTRKDYQQIYIALFKMPQWSLKGFTPNLLFKHTRNRSNADYVYSYKQSEVQLNFEFQF

SEQ ID NO: 497 - DNA, 1464 bp, P. burhodogranariea
atgttgaaacgtcaattcagtattttattatttttctttttttatagttacccagtgagtggggtatccgatggtctagaaaattatcgattcctattaaagggaaaaactgggttgaataatcaaccgttgatattaaaaagcactgaaccctttattaaaaatgaaataattattaactttgataataaaaactataaaataaataataatgttaatgaaatgggaatggcgatttatatcgcattaaatcgtgggcaatatcaggatgttcacagattattaccttattatcaaaaattgcctgaatatgattatttattagttaaatttgctgaagcacaatttgcaagaatagataaaaattacattaaagctatctctgattatcaacagatcttaacattaaagcctgattttttacgtgtagaactcgaacttgcacgaacctattatgaagataagcaaaacaaagaagcattattactatttaaaataatattggataaatatgctcagcagcttccagctaatgtatcaattgtaattggtcaatttacaactgaactgaataaaaaaaaccgttggtcaggaagtttttctacaggctatggttataattcgaatattaaccaagtgcccaataatgatagaaaaacctgttaccagaatttacaacagcatctttgctatggcggtagtcaagcagataaaggcagtaagtttatttatgatggagatattaatcggtcatttgcgttttatcagcaccaaagtgttcagtttaaagcttactcctttggcagccactatgagagaaatgctgattataatgaaaataccaccaatataagactgtactatcaatatcatgatgccaacaaatcgttatcaatagggccaataaccgaattgaaatttgtgggaggcaaacggcgctattatggtgtgggaacggggattgacgcagagtatcgtttttcaccccaattttcgttaactgcgatgatagattctaaaaaaatgatttatcgtactccttaccaaagtaatgatggaaataaaagtaatctctacttaacgggaatttatgcgttaacccctgaggctgttctctttggtggaattgatagttcacttgttaataaaaaatatgaaagtgatagctatcggcaatacggtgctagagttggtgtctttaaaaaatttaatcaagacgtaaattttcttgggctaatatcttataaaaatacgcgatttaatgatgctcaatatgaatttaatcataaagtcagaaatgatgatgaacagctctatttaacgaagctcagcattccaaaatacagttttatgacattgattccctctatctcttataagtacagaattaataatagcagtattgatacgttgtactcttataaacaaagtgaagttgaatttaaattggaaaaacgtttttaa

SEQ ID NO: 498 - protein, 487 aa, P. burhodogranariea
MLKRQFSILLFFFFYSYPVSGVSDGLENYRFLLKGKTGLNNQPLILKSTEPFIKNEIIINFDNKNYKINNNVNEMGMAIYIALNRGQYQDVHRLLPYYQKLPEYDYLLVKFAEAQFARIDKNYIKAISDYQQILTLKPDFLRVELELARTYYEDKQNKEALLLFKIILDKYAQQLPANVSIVIGQFTTELNKKNRWSGSFSTGYGYNSNINQVPNNDRKTCYQNLQQHLCYGGSQADKGSKFIYDGDINRSFAFYQHQSVQFKAYSFGSHYERNADYNENTTNIRLYYQYHDANKSLSIGPITELKFVGGKRRYYGVGTGIDAEYRFSPQFSLTAMIDSKKMIYRTPYQSNDGNKSNLYLTGIYALTPEAVLFGGIDSSLVNKKYESDSYRQYGARVGVFKKFNQDVNFLGLISYKNTRFNDAQYEFNHKVRNDDEQLYLTKLSIPKYSFMTLIPSISYKYRINNSSIDTLYSYKQSEVEFKLEKRF

SEQ ID NO: 499 - DNA, 1473 bp, P. cremoricolorata
atgggccggatactgctcggcctgtcgctgctgtataccgccgtcgtccaggccgacgatgacgacacccgcctgctgctgaacaagatcgaacaacgcggcgaagcccgtgagcgggccaaccgcggcgcgcccgatccggcacagcacaatgcttcgctgatcaccatcgagggccagacctacaacgtgcagaacaccctgcaggatcttgcgccggccatttacgtgtcgatcaacctgcgccagtggggcaaggtccgtcagttcgtcgagcgctaccggcagttgcccggtcatgagccagcgctggtggaaatggccgagggcctgttggcccgccagcagcgccagcacaagcgggccatcgatcacctgcgccgcgccatcgagctgaacccgcgcttcgtgcgtgcgcaactggaattggcccgcaccctgttcgaagacaaccagacccttgaggccgaacgcctgttccgccaggtcgccaacgaaaccgtgcccgagtcgctgcatggcgtgctcggtgagtaccagcaggccatcgacctgcgccggcaatggcacggatccgcctcgctcgggctgggctacaacagcaacatcaaccagggcaatggcatggttacccaccgcctggtctgtacgatcttcgatgaatgtttcgactatgcccggcaaatgcccaagcccaagggttctgcaagtctggtctatgacgtcaccgccgagcggcgctttcagctgaccggcaatcaccacctgctgctgcgcggcctgagctacggcaaccagttcgacaagcatggcgaggacgacccacaaatctggtacgacgacaacaccacggtgctctacgccggctacaacttccagagcgtgctcaacgacgtgtcgttgatgccgctgttcgagaactactacaacgaccaccacaccaagtaccaggccaccggtgtgcgcggtgagtggaagcacaacctcagcgagcgcctgcaactgggcggccaggcgcagttcaagcattaccgtttccagggtgagcagcgcgagtacttcgatgactacgatgagcgccagctgggggcatcgctgtcgtacctgctcgatgcgcagaccttgctgttcggtggactgacctacacccggcgtgaacaaaaagccgcggcgtcgagcaaccgcgaggcgatggtcagcctgggcgccttccacagcttcgacgccgggctgaccctgagcgccgtgggcctgtaccggcaaacccgctatgacgcggcagatcttttcctcggtggccggcgcgaggatcgccagcaggtctatatcgccaacctgggcatgccgcgcctggccttcgccggcgtggtgccgaacctctacgtcaagcgcacggtgaccgccagcagcatcgattgggcctatgcctaccggcagaccgagctggcgctgaaattcgagaagaccttctga

SEQ ID NO: 500 - protein, 490 aa, P. cremoricolorata
MGRILLGLSLLYTAVVQADDDDTRLLLNKIEQRGEARERANRGAPDPAQHNASLITIEGQTYNVQNTLQDLAPAIYVSINLRQWGKVRQFVERYRQLPGHEPALVEMAEGLLARQQRQHKRAIDHLRRAIELNPRFVRAQLELARTLFEDNQTLEAERLFRQVANETVPESLHGVLGEYQQAIDLRRQWHGSASLGLGYNSNINQGNGMVTHRLVCTIFDECFDYARQMPKPKGSASLVYDVTAERRFQLTGNHHLLLRGLSYGNQFDKHGEDDPQIWYDDNTTVLYAGYNFQSVLNDVSLMPLFENYYNDHHTKYQATGVRGEWKHNLSERLQLGGQAQFKHYRFQGEQREYFDDYDERQLGASLSYLLDAQTLLFGGLTYTRREQKAAASSNREAMVSLGAFHSFDAGLTLSAVGLYRQTRYDAADLFLGGRREDRQQVYIANLGMPRLAFAGVVPNLYVKRTVTASSIDWAYAYRQTELALKFEKTF

SEQ ID NO: 501 - DNA, 1524 bp, P. dagmatis
atgaaacaaaaatcgctttctttattcacttactttgcagcattatttgctgtatcaagtttaatcagccaaacatcttccgcaaatgatactgttgttcaagttgacaactctcgaccagaagaatctttccgccaaccaacagcaatcaaacaagaacaaatgccttctcgagcaagttctccggcaataactacgcctcaaaaacagcaattatctatcaccccagaacaattattacagcgccctgatttattaatccgagcattaattcctgcattaagaaataatgatatgcgggtcacagagttattattgccaatttatgaaaaattacctgaacaagaccctattctattgaattgggctcgcgcaatggtggcgaaaaaacaaggtagattaaatgattccatccgtttatatcgtgaggtgattgcagaacagcccaaaatacagcctgcacgcttacaattagcaattgtattaatgcaaaaccgtgaatacgatgccgcaaaagatcaattccaacaattacgtgcagaaaatttacccccacaattaatacaaattattgataactacgttaaggctatcaacgagcaagacagctggagcttctacagtggaggcaattatttgaacgagaaaaacgtgaataatgctcccaaaaaagggactaaagctggcaacttcacaccatcaagtgaacctgaaagtgcagaaggaatcagctactatttcgggataaataaaacttggtcaattaaacatggttttttcactgaatttgatgccgatctaaatggtaaatattattggaataaccgtaaatatgatgaagtatcattgcgtggcggtcttggtgttggttatcgtaatgctaaaacagaagtaaaattcatcccttatttagagcaattttggtatgctggtggtgaaaatgccaaaaaagatgcccgtacgttacaccgatactcaaaaaccagtggcgtagctttcgatattagctattggttaaacccacattggaaaatctctaccgcacttgaatacggtgaacagcgttatctcgatccgagacgtagaaaatccaacggcaatttctattcagcaacaaatacattgatatatttcccaaatagccaacaatattggtttgcgggcttagatttttatcgaaaaaacgcccattggaaggcaaatgcctttgatcgccctgctgcacgtttaggctggggacaagagtggccaaaagggatttcaacccgtttacagatcagctatgcaaaacgatcttaccgtatgccatcagcacctcaaaatgcaatttttgcaccaattttctttaaatttgcgcagaaaaatcaagaatatggtgtgaacctaactatatggcatcgtagtattcactggctaggcattactcctaaaatcacttggtcataccaaaaaaccgatagtaacaacccatttgcacgttatgaccgcaaccgtgtttatctaagtgtaagtaaaaatttttaa

SEQ ID NO: 502 - protein, 507 aa, P. dagmatis
MKQKSLSLFTYFAALFAVSSLISQTSSANDTVVQVDNSRPEESFRQPTAIKQEQMPSRASSPAITTPQKQQLSITPEQLLQRPDLLIRALIPALRNNDMRVTELLLPIYEKLPEQDPILLNWARAMVAKKQGRLNDSIRLYREVIAEQPKIQPARLQLAIVLMQNREYDAAKDQFQQLRAENLPPQLIQIIDNYVKAINEQDSWSFYSGGNYLNEKNVNNAPKKGTKAGNFTPSSEPESAEGISYYFGINKTWSIKHGFFTEFDADLNGKYYWNNRKYDEVSLRGGLGVGYRNAKTEVKFIPYLEQFWYAGGENAKKDARTLHRYSKTSGVAFDISYWLNPHWKISTALEYGEQRYLDPRRRKSNGNFYSATNTLIYFPNSQQYWFAGLDFYRKNAHWKANAFDRPAARLGWGQEWPKGISTRLQISYAKRSYRMPSAPQNAIFAPIFFKFAQKNQEYGVNLTIWHRSIHWLGITPKITWSYQKTDSNNPFARYDRNRVYLSVSKNF

SEQ ID NO: 503 - DNA, 1500 bp, P. fluorescens
atgccccagccctactgcaagcgatccctcacgctccacgctttacccttttccctgctgctgttcatggcccctgcgctatttgctgccgaccaggacaccagcttgcgcctgaaccagaccatcgagtaccgcgccaatcagcaagagcgcgagttgctcaaggatgaattgcccagcgacggcgccgcgccactcttgaacatcgacggccaggactacaccgtcggcaacaacctggatgaattgggccgcgcggtgtacgtgtccctctcacgccagaactggccacaggccagggactatctcaaacgctacaccgccctgcccggccatgatccgatgctcaccgcctatgccaaaggtggcctggcccgcgccgaaggcgacctggagcaagccgaagattattaccgccaattgctggcgatacagtccgacttcctgccgggccgcctggagctggcgcgggtgctgttcgagaaccgcaaggatggcgagtccaacgccgtattccaacagatcagcagtggcctcagcccctccgacgcgcaggccatgggcctgggcaagaccgtcgacagtttcaagcaggccctggatcaccgcgaagactggcaaggctccttcgccattggcccgacctggggcaaaaacctcaatcagtcccccgaaagcacagtgacgtatcgctacgtcactgccgaagaaaccattctggtccaacgctcgctgcccaaggctgtgtctgcccacggcgcggattacgaggccacgctcaacaaacgcatcgccctcagcggtcatcacggggtgttcatgcgctcgctgttgtacggccaggcgtatgaaaaggagagcaagtacaacgaaagcacccttatcaacaacgccggctacagctatcacgatgcgaaaaaccagtactccctcgggccatcgtatgagttcaacaccatcgccgacaacgccatgtacagcgcctgggggttgcggggcgaatggattcacacgttatcggctacgcgcatgttcaagctggaaggcgaatacaaggacatggcctacaagcacgacctcaacagcaacctcgacggcggcattagctcggtctacgccactctgtggcaggccctgccccagcgctggacgttgttcggcggcgtcgacctgagccagcgcaacgcacgggatcgcacccaggcttacctgcaaaaaggtgtgcggctgggcgtcgccaaggatttcgaggtgggagtcagcgctgtgctgttcgcgtcataccgcaaacgccaatacgatgcctacagcgccctcgtcgatgaccgacgcagcgacgatgaacagggctacacctttatcctgcgcgccccacgcctggcggtgatggaagtggtgcccagtctgacggtcaaatacaacaaggtcgtaagcaatgtcgactggctttattcctacgacaaaaacagcatcagcctaaagctggaaaagcagttttaa

SEQ ID NO: 504 - protein, 477 aa, P. fluorescens
MAPALFAADQDTSLRLNQTIEYRANQQERELLKDELPSDGAAPLLNIDGQDYTVGNNLDELGRAVYVSLSRQNWPQARDYLKRYTALPGHDPMLTAYAKGGLARAEGDLEQAEDYYRQLLAIQSDFLPGRLELARVLFENRKDGESNAVFQQISSGLSPSDAQAMGLGKTVDSFKQALDHREDWQGSFAIGPTWGKNLNQSPESTVTYRYVTAEETILVQRSLPKAVSAHGADYEATLNKRIALSGHHGVFMRSLLYGQAYEKESKYNESTLINNAGYSYHDAKNQYSLGPSYEFNTIADNAMYSAWGLRGEWIHTLSATRMFKLEGEYKDMAYKHDLNSNLDGGISSVYATLWQALPQRWTLFGGVDLSQRNARDRTQAYLQKGVRLGVAKDFEVGVSAVLFASYRKRQYDAYSALVDDRRSDDEQGYTFILRAPRLAVMEVVPSLTVKYNKVVSNVDWLYSYDKNSISLKLEKQF

SEQ ID NO: 505 - DNA, 1455 bp, P. geniculata
atgcgccattccattttccttgtcgtactgctgttggctgccaccgaggtgcgcgcccagcaggacgatcttcgtcgtgtgcttgaacagggcaccgaactgcgccaccagcagcaggaccagcagcgcctgcagcaggccgagtcggagcggccgaccatcaccatcgacggccagacgctgcgcgtggagcgcaccgtcgatgatcttggccaggccctttacctctctctgcagcatcagcaatggcaggccgccgctgcgttcctcgatgagtacatcgaactgccggggcatgaccccctgctgcgccactatgcgcagggggcgctggcgcgggtggcgggcgaccatcgtcgcgcggcgatggagtacgaagcgctgctggcggcgcagccggatttcctgccggcccgcctcgagctggcacgtgtctatgcggaagaccagcgcgatcgcgatgcggccgcgctgttcaccgccatcgctgcaggcatcaatgccgatgatccggccacggccggcgtccgcgcgcgcgtggacggttacctgggtgccctgcaggcgcgccagcgctggaaaggcgcgctgtccgccggcccggcatggagtgacaacatcaaccgcagttcggccagtcgcacctgcctgttcggcgtgggcgacgcctgcatcatcgaacggaaactgccggacgcccagcgcgcggcgggcctcgactacgacgccagcctggaacggcgctgggtgctcggcgggcatcatgggctgtacgtgcgcggtctcgccttcggccaggcatggcgcgggcacagtgcgtacaacgagctcaatgccaacgtgcaggcgggttacagctggcgtagtgcacggcagaccgtgatgctcgcccccagctatgactatcaggccctgggcaaccatgcgctgcagggcggcagtggcgtgcacgcggaatggcagtacgccctggatgcacgcagcctgctcaagctggaggctgactggaagcgccagcgctatcgccagcagggccttgccagcaactacgacggcgagctggcatcgctgtacgccacctggttccgcgcgctcaatccacgctggacggtcttcgccgggctggatgtcaccgacagcagcgcagccgacgcggccaacggcttccgccagcgcggcctgcggctgggcgcggcgcggcagtggagtggcaccacggccaccgtattcgtgtcgctgcgccagcgcgactacgacacctggagtccgttgctggaggcgcgcaggcaggacgacgaacagaacctgatcgccatcgtgcgcagcgagcgcttggccgtggccgggctggtacccagcctgagcctgcgctacgcgcgcatcgacagcaacgtcggctggctgtacagccacgaccgcagcctgctcagcctgaagtgggaacgggccttctga

SEQ ID NO: 506 - protein, 484 aa, P. geniculata
MRHSIFLVVLLLAATEVRAQQDDLRRVLEQGTELRHQQQDQQRLQQAESERPTITIDGQTLRVERTVDDLGQALYLSLQHQQWQAAAAFLDEYIELPGHDPLLRHYAQGALARVAGDHRRAAMEYEALLAAQPDFLPARLELARVYAEDQRDRDAAALFTAIAAGINADDPATAGVRARVDGYLGALQARQRWKGALSAGPAWSDNINRSSASRTCLFGVGDACIIERKLPDAQRAAGLDYDASLERRWVLGGHHGLYVRGLAFGQAWRGHSAYNELNANVQAGYSWRSARQTVMLAPSYDYQALGNHALQGGSGVHAEWQYALDARSLLKLEADWKRQRYRQQGLASNYDGELASLYATWFRALNPRWTVFAGLDVTDSSAADAANGFRQRGLRLGAARQWSGTTATVFVSLRQRDYDTWSPLLEARRQDDEQNLIAIVRSERLAVAGLVPSLSLRYARIDSNVGWLYSHDRSLLSLKWERAF

SEQ ID NO: 507 - DNA, 1485 bp, P. halotolerans
ataccgtatttgagccgcctgtcctcagtcgtcggtctggctttgctttcatttttatttgtggcgcagatggcccacgccgatccggataccaatctccgtctggaacagaacaccagcctgcaagcccgggagaaagaacaaagcctgctggaagaagaacaggcccgtgaacaggccgaagcactggtcattgacggccagatatatcaggttgaggacaacctgaacgcactgggacaggcgatttatctgtcggtcaaatcccggcgttgggtggcggttcgcggctttctgacccgctatctggcactgcccggccatgacatgatgctggtgcactatgcacagggggcgttagcccgctcagacggtgaattcgcacaggcagaacagtcataccgggcgctgttgcagttacagccggattttctgccgggtcagcttgaactggcgcgtgtgttgttcgaaaaccagaaaaaccgcgatgccctgaggctgtttgaagacattcgcgtcgctctgcccattcatgaccccaaagcgcagggagtcatgaaaacggtcgatgctttttctcaggcgctggcataccgggatagctggcagggcgcgctttctttcgggcccggcttcaacaataatctgaatctctcttcagaaagttatacctgcttactcctgatgccgaatggcgagtgcctggtggagcggaaaacaccgacagccgaatcggcatacggcacgacctttgaagccagtctgaataaacgcatttccctgagcggccatcatggcatcagctttcttggtctggcttatggcgagaactatattcaccacagtccgtacaatgaacataccctgttgagctatctgggttacagctatcacaccgccaactatcagttgttcgcagcacctttgtttgaataccgcacgcaaggaaacgatgcgctctatcaggcctggggcggcaagctgagcgggctgtatctcttctcggcagccacggcctttaagctggaagctgaggcgaaagatctgcaatttctgcctgacgggctggatgttcaatccggctggcaatacgccgggtatgccacgctctggcaccagttgccgggacagtggctgctgtttggcggactggactggacggataaacacgcgcaacaagctgtgcatgcctatcagatgaaaggcgtccggcttggtgttcagcgttcttgggaggtggggattgaaacctcactcttcacgtcgttccggcagcgggaatatcaggcctacagtcctttgctggaagcgacccgaaaagacgatgagcaaagctacacgctggaaacccgtttcaccggattacgtttttgggatctgacaccagtgctgacgctagcgcacaaccgggtcagcagtaatgtggactggctgtacagccatgaccaaagcgaggtgagtctgaaaatcgaaaagcgtttctga

SEQ ID NO: 508 - DNA, 1284 bp, P. halotolerans
atgcgcattctgatcctcgctctggcactggggctgacactgaccggggcggtggcggcccgcggaccggacggcgcgctgctggcgcggcttatggccttaggggaccatgacggcgcgcgagcccatcttgccgccgccgtctccgaaccggcgctgcatgccctttatcgcacccatctcgaaggattgatcgcccggcagcagggcaggtcggccgatgccgttgcgctttttcgcgccgttctggccatcgaccccggtttcgttgcggcgcgtgtcgaactggcaaaaagtctgctcgccacgcgcaatttcgaaggcgcgcagcaccatctcgatagtctcgcgctcaacgccgacgacgcaattcgcacgattgcgcaggcgggcctcgaccatatccgggccaatcgcggttatggcgcgcagatgcatttttccatcgcgccatcgagcaatctcaaccggggcagcgcgcaccggatttttgccgcaggcgggatggattttgcgatcgaccccgattcgcgccggaccgcggggacgggcatcaccatcgggggcagcgcctatcacagcttttcccttggcaacgggcaggccgtcattgcaaatgcggcggtcgatctgaccaccgatatcgagggcacacgggccgaacagctttcgctgagcgcggggctgaactggcaggggcgtttgggcaattcccggtttggcctcggcccgattgccgatgtgagctattcagggttcgatccgcatctggtgcgctatggcttgagcgggacgctcaatgttccggttggcgggcaaaatctcgtggggctgagctttacggtgctggggcaggactatgcctcgcaggcctatcgcaacgggtttcgggtgctggcgggggcgcaagtgacccatgccttcaccccggccgtgcgggcgagcctgcaactgggcgcggatatcgagcgtacgcaagccgctcatctcgaccgggatggggtgtttggagacgtacgggtggtgagcgattggcggggcggattttcgacggcgctgtttgtgcgctacgctcgcgaccagtatctgggcaattaccccggcaccggcacgccgcgcctcgatgagcggttgagcgccgggatcacggtttccaacagccagatcgatctgggcggttttacgccggcgctgagctacagctatacgcggcaattttccaatgtgagctttttcgaccatgacagccacgatgtcagcctggggttgaccaaggcgttctag

SEQ ID NO: 509 - protein, 494 aa, P. halotolerans
MPYLSRLSSVVGLALLSFLFVAQMAHADPDTNLRLEQNTSLQAREKEQSLLEEEQAREQAEALVIDGQIYQVEDNLNALGQAIYLSVKSRRWVAVRGFLTRYLALPGHDMMLVHYAQGALARSDGEFAQAEQSYRALLQLQPDFLPGQLELARVLFENQKNRDALRLFEDIRVALPIHDPKAQGVMKTVDAFSQALAYRDSWQGALSFGPGFNNNLNLSSESYTCLLLMPNGECLVERKTPTAESAYGTTFEASLNKRISLSGHHGISFLGLAYGENYIHHSPYNEHTLLSYLGYSYHTANYQLFAAPLFEYRTQGNDALYQAWGGKLSGLYLFSAATAFKLEAEAKDLQFLPDGLDVQSGWQYAGYATLWHQLPGQWLLFGGLDWTDKHAQQAVHAYQMKGVRLGVQRSWEVGIETSLFTSFRQREYQAYSPLLEATRKDDEQSYTLETRFTGLRFWDLTPVLTLAHNRVSSNVDWLYSHDQSEVSLKIEKRF

SEQ ID NO: 510 - protein, 427 aa, P. halotolerans
MRILILALALGLTLTGAVAARGPDGALLARLMALGDHDGARAHLAAAVSEPALHALYRTHLEGLIARQQGRSADAVALFRAVLAIDPGFVAARVELAKSLLATRNFEGAQHHLDSLALNADDAIRTIAQAGLDHIRANRGYGAQMHFSIAPSSNLNRGSAHRIFAAGGMDFAIDPDSRRTAGTGITIGGSAYHSFSLGNGQAVIANAAVDLTTDIEGTRAEQLSLSAGLNWQGRLGNSRFGLGPIADVSYSGFDPHLVRYGLSGTLNVPVGGQNLVGLSFTVLGQDYASQAYRNGFRVLAGAQVTHAFTPAVRASLQLGADIERTQAAHLDRDGVFGDVRVVSDWRGGFSTALFVRYARDQYLGNYPGTGTPRLDERLSAGITVSNSQIDLGGFTPALSYSYTRQFSNVSFFDHDSHDVSLGLTKAF

SEQ ID NO: 511 - DNA, 1365 bp, P. hauseri
atgcgttattatcaaaaacgaatgaaattatttattatcattagtgtgttacttattccattaaaaataaacgccaacgaaaataatgcgattttattctcctattcttcacctcaacaccaagttgcacaaatagggcaacaactttatcgcgctttacagcaacagcagtggaaaaaggctgaagaactattactggactatcaacaattacctttacatgaaacactattaattaattacgctaaagcgcttttagctcaaataaaaggtgattttttaaacgccgaattttattatcagcagcaacttaaacaaaaagtcgattttatcccagcgcaaacagggttaattcagctttattttcatttacgagaatataaaaaagcacaacgacaacttaatcaattgagcaatatgattgatttacctaaagatattatccaatctattgcgttttatagagctaaattagcctcttattttcaaggccaacgtttctatcaacttagtttcttttatgatgataatattaatcatgcacctgatttagctgaaaaaattgtctctcaatctactcaaagaaaaatgacgctaagaggtgctaaacccattgtatcaacaggacttgctcattatttttctttttatcagccttttattctttattctcaccatactttttcttcttatacttatgcacgatatatcgattatcactcttaccgtagtgctaattttcttgcgttatatacccaactgggctatcgctaccaaaaacctcaatatcaatggtcaatcacaccttattacgaaataaaaaaaacaccaactcaatatgaatatcaagcctggggaagtgaaacacaattttcttatttgattaataaaaagcaaactattaatttaagtttggattataaaataaagaaatatcaagaaacgttaaagaatttaaatactcagcgactgagttatagcactaatcataactattatttaaataatagagtgaatttacttaatcaattaaattatcaattaggtcgtaaaaaaaacactttattaaattatcagctgtatggtataaaaactggcgtttattatccattgtcagtaaattggcatatgtctctttttttacagtatcaatttaaacaatttaataactataatcctttattaaaaaagagaagaaaagacaatagctttatttttacaaccaatattaaaaataaatcaccctttattttagggttttatcccgcaatagagttacgttatacccgaagattaagcaatgtggattggttatatcaatatcagcaacatgaagtattatttaaattagaaaaacaattttaa

SEQ ID NO: 512 - protein, 454 aa, P. hauseri
MRYYQKRMKLFIIISVLLIPLKINANENNAILFSYSSPQHQVAQIGQQLYRALQQQQWKKAEELLLDYQQLPLHETLLINYAKALLAQIKGDFLNAEFYYQQQLKQKVDFIPAQTGLIQLYFHLREYKKAQRQLNQLSNMIDLPKDIIQSIAFYRAKLASYFQGQRFYQLSFFYDDNINHAPDLAEKIVSQSTQRKMTLRGAKPIVSTGLAHYFSFYQPFILYSHHTFSSYTYARYIDYHSYRSANFLALYTQLGYRYQKPQYQWSITPYYEIKKTPTQYEYQAWGSETQFSYLINKKQTINLSLDYKIKKYQETLKNLNTQRLSYSTNHNYYLNNRVNLLNQLNYQLGRKKNTLLNYQLYGIKTGVYYPLSVNWHMSLFLQYQFKQFNNYNPLLKKRRKDNSFIFTTNIKNKSPFILGFYPAIELRYTRRLSNVDWLYQYQQHEVLFKLEKQF

SEQ ID NO: 513 - DNA, 1500 bp, P. luminescens
gtgatattaccgatgctaaatacctcaattgttcgttttactttactcattagttgtttgtttatagagccatctctagtgttggcagatgaagataccggtagaagattgtggtataacgtacagcgaaatttgcaggatcaagaaaaagcgttggtcacagatgaaaccgtggataaaaaaacggatcatttattgatagtccttaatggtcaaacgtttagtgttgaaaacaatgtgaatgatattggtcaggcgctttatttagccattaatcatcaacaagtgcaggatgttgagcgttttttatcgatgtaccagaaattacctggacatgatacccaattggtccattttgctcaggcaaatctggcgcgtttacaaggtgacttagtagcagcagaacagcattatcaggccatcttgcagcaacaacctgattttacccgggctaaattagagttagccagagtctattatgagaatcaaaagaatagagaagccagcttactatttaatgagatttcagcagttagtcgcgataatgaaaataaattaccaccagcagtcattaagaatataactaattatcaggaggcgattaatttgcgtaattcctggcgtggatctttctccgtaggatatatctttaacgataacacgaatatgtcgtcagataagcctcctgtttgcactctctatcgtgaaaatggtgagtgtgcggttgaacgtaagctgcctatggcaaagaaagcgaatggtattagttatgatgctacgttacgtaagatatatccgctaagtggtcaccacggtgtctttttacgttcgatgacttatggggaaagttatcgtcatcatagtgaggagaatgaaaatacgacttctgcttattttggttatagttataaagcgcaaaaaaatgatttcctaatggggccagttgttgagtttaattctgttggtaaccattcccgttatcgtactacgggaataaaatctgaatggatgaatattttatctgaaaatttggtattgaatttggaaggtgaatataagcagtttcgttatcataaactttataatcataatgacggtaatatggcctctgtttatgccaccttatcttattatttaactgatcagacaattacctttgcgggtggtgattgggttaataaaactagtgttgagaaagctgacgattatcaacaaaaaggtgtgagagcaggcatttcaactcaattgtatccgggaattaatgcagtggtatttactgtattacgccagcggcaatttggtgattacagtgtgcctctaaatgcacgtcgtaaagataatgaacaattctatgcggcaattgtgagtatgcctaaatttgaagttttcggtttaaccccagtaattacttatcggtttagaaaaaataatagtaatgttgattggctctattcctataataagaatgaagtgttagtcaagtttgaaaagtatttttga

SEQ ID NO: 514 - protein, 499 aa, P. luminescens
MILPMLNTSIVRFTLLISCLFIEPSLVLADEDTGRRLWYNVQRNLQDQEKALVTDETVDKKTDHLLIVLNGQTFSVENNVNDIGQALYLAINHQQVQDVERFLSMYQKLPGHDTQLVHFAQANLARLQGDLVAAEQHYQAILQQQPDFTRAKLELARVYYENQKNREASLLFNEISAVSRDNENKLPPAVIKNITNYQEAINLRNSWRGSFSVGYIFNDNTNMSSDKPPVCTLYRENGECAVERKLPMAKKANGISYDATLRKIYPLSGHHGVFLRSMTYGESYRHHSEENENTTSAYFGYSYKAQKNDFLMGPVVEFNSVGNHSRYRTTGIKSEWMNILSENLVLNLEGEYKQFRYHKLYNHNDGNMASVYATLSYYLTDQTITFAGGDWVNKTSVEKADDYQQKGVRAGISTQLYPGINAVVFTVLRQRQFGDYSVPLNARRKDNEQFYAAIVSMPKFEVFGLTPVITYRFRKNNSNVDWLYSYNKNEVLVKFEKYF

SEQ ID NO: 515 - DNA, 1353 bp, P. mirabilis
atgcgttattatcaaaggctaataaagtcattatttattattaatatcttatttcattcgtcacagggggcggcaacacaacctaatcaagagcagcttaataaagagaaggtcgctcaattaggtcaacaactgtatcaccatttacagcaacagcagtggtatcaagcggaaaaactattagttaattatcagcaattaccattacacgaaactttattagtctattatgctcaagcactattagcacagaagaatggtaatttcttacaagctgaattttattatcagcagcaacttaagcagcaagcagattttattccggcacaaacaggtctaattcagctctacttttctcaaggagaatataaaaaagcacaataccagctaaatcaattaagtcgtttatcgggattatcacctgccattaatcaagcaattatctattatcagaaacagcttaacgattattttaaagctaggcgtttttatcaaatcagttttttttatgatgataatattaatcatgcaccttatcttgatgagcaaattgtttcgcaatcaacgcaagtcatcatgaccagaaaaggcgctcaacctatagcatcgatgggggttagtcatcttttttctttctatcagcccacttttatttacgctaataataccctatcaggctatttttcagcacgctaccgtgattattttgcatataaacaagctaattttacacatttatatactcaattaagttatcagtaccaaaaaaaggattatcggtggaccttatctccttattatgaaataaaatcacctaaaaaggcgtttgagtatcaatctattggggtatataccgggctatttttctctattaataaatatcattctattaatttatctataaattattatataaagaaatataataaagaattaataaacttaaataatcataagcagctatatgctattagctattactatacattagcagagaatgttcaattagttaatcaattaaactattatagtagtcgtaaaaaaaatactttattaaattatcagcaatatgatataaaaacgggtgtttattacttattaccaaaaaattggcaagtttctctttctttacaatatcaatttaaaagttttaataattataatccattattaaataagaaaagagaagataatggctttgtttttacaacaactattaaaaataaagcacctattatctggggtttttatccagcaatagaattaagttatacccgtagattaagcaatgtggattggttatatcaatatcagcagcatgaagtcttatttaaattagaaaaacaattttaa

SEQ ID NO: 516 - skipped

SEQ ID NO: 517 - DNA, 1524 bp, P. multocida
atgaacttaatgataaacttaaaaccgcttacttttttaccttttttcggtcgccttgtttttctctctggcgttatttataacaccgcgtgggcgaatactgtgatccccgtagataatagccgaccagatgaaacattttcccagacgtcacctaaacagcatctcttttctcagaaaccgactgaacccacatcaagtgcgagcagtcagcaaatttcgttgaccattgaacaacttgctagcagacctgatttggtgcttcgcgccttaatcccagcattaaaaaataatgatatgcgcggtgttgaaatcctcctacctatttatgctaaacaatcacccgatccctttttattaaaatgggcacaggcaatggttgctcgtaaacaaggcaaattaaatgaatccgtgcgtttatatcgccaaattattgcagaaaagcccaatttacaacctgcacgcttacaactcgctatcgccttaacgcaaaaccgtgaaaatgaagctgcgaaagcacaatttaaccaactgcgttcagaaaacttacccgcgcctttactgaccctcattgatagctatattgatgcgattaaccaacgcgatagctggaatgtgtatggcggagtaaattatttgcatgagaacaatgtcaataatgcaccgcctaaaggtaccaaagcggaaggcttcaccccgtcaagtcaaccagaaaaagcacatggtttaagttattttattaatttaagtaaaaattggtcattagcccacggctttttcacagaatttagtgccgatatcaatggaaaatattattgggataatcataagtatgatgagttttcgactcgcctcaatctaggtggtggttaccgtaatgccaaaacagaagtgaaacttatacctttcgtggaacaattttggtatgtgggcggtgaaaatgcaaaaaaggatgcacgtacattacaccgttattctaaaagctcaggtatcaaccttgacgtggactattggttgacacccaattggaaaatctccacggttctggaatataccgaacaacgttatatccagcctcaacggcaaaactcaaatggaaatagctattccattagcaatactctgatatatatgccaaatagccaacaattttggtttgttggactcgattattatcaaaaaaatacccggctaaaagcctatgcttttgaacgtcaaggaatacgtctaggttgggggcaagaatggccgaaaggcatttcaacgcgtttacaaacaagctatgccacgcgtacttatcgagcaccttcagcagaaaagaatatgattttcgcgccgagtttttttaaagttgtgcaaaaaaatcacgaatacggtgtcaattttacgatttggcatcgtagtcttcactggttggggatcacgcctaaaatcacttgggcatatcaaaaaaccaccagtaacaatcctttttccgaatatgaccggaatcggatttatttaaccttcagtaaaacattttaa

SEQ ID NO: 518 - protein, 507 aa, P. multocida
MNLMINLKPLTFLPFFGRLVFLSGVIYNTAWANTVIPVDNSRPDETFSQTSPKQHLFSQKPTEPTSSASSQQISLTIEQLASRPDLVLRALIPALKNNDMRGVEILLPIYAKQSPDPFLLKWAQAMVARKQGKLNESVRLYRQIIAEKPNLQPARLQLAIALTQNRENEAAKAQFNQLRSENLPAPLLTLIDSYIDAINQRDSWNVYGGVNYLHENNVNNAPPKGTKAEGFTPSSQPEKAHGLSYFINLSKNWSLAHGFFTEFSADINGKYYWDNHKYDEFSTRLNLGGGYRNAKTEVKLIPFVEQFWYVGGENAKKDARTLHRYSKSSGINLDVDYWLTPNWKISTVLEYTEQRYIQPQRQNSNGNSYSISNTLIYMPNSQQFWFVGLDYYQKNTRLKAYAFERQGIRLGWGQEWPKGISTRLQTSYATRTYRAPSAEKNMIFAPSFFKVVQKNHEYGVNFTIWHRSLHWLGITPKITWAYQKTTSNNPFSEYDRNRIYLTFSKTF

SEQ ID NO: 519 - DNA, 1467 bp, P. parafulva
atgccgcactgctatcgctcgttcgttggtatcttctttgctgtgttttttccgagccatgctcaatccgatcaggatacagacctgcggctcaatcagacaattgactaccgtgccacagtggaagaccggggtttccagcaggcgcctggcaccctgtctctcctgtccgtggatggccatacctatcaagttggcaataacctggatgatctggggcgggcgctgtatctctcggtacagcggcagcagtgggcggatgtgatcttttttcgagcacgctacgcggcacttccagatcatgaccccatgcttctggcctatgccgatggtgcacgcgcacgcgccgatgggcaattgagtcaagccgaagttgattatcggcacttactggccctgcagccagacttcttgccaggccaactcgaactggcgagggtgctatttgaaaatcgtaaagatcgggagtcggcggacgctttcagccgtatccgctcgtcccttgaccctgcagacacgcaaaatcgagggttgctccagagcatcagtagtttcacccaggcactcgatcggcgaggtcaatggcaaggctcgttggccgtagggcccacgtggagtaataacctcaaccggtcctcggagagccgaaccacctaccgccttgcatccagcgagggtgtatacgtgatagaaagaaggatgcccaaggccgtttctggagacggcatagattacgaggcgaccctgaataaacgcgcagccctttctgggcatcacggcgcctacatccgagcgcttgcgtatggccaagcctataaggggcaaggcaaatataacgaggatacattgactgctcatgcaggctacagctaccaaaatgcacgcaatcaatacagcctaggaccacttttcgagttcaaccgcatgggcagtgatccgatgtcaactgcctggggcctgcgcggtgaatggatgcacaacctgagtgccacacgtttgctcaaactggaggttgaatacaaagacctcgcctaccgagggctgtatgcaagcgcttacaatggtagcgtcacctcgacgtacgcgacactttggcaagcaatgccccaacaatggttgctgttcggaggcttcgatttcacggaccggcgcgcgaaaaatgacgttgaaacttatttccaaaaggggctgcgtgcgggggtagccaaggaatttggttcaggcttgagtacagtactgttcgcctcttggcggacccggcaatatgccggtttcagcgcgccccttaatgcgcgccgacacgaagaggagagtggctataccttcatcgctcgagcgccgcggttggctgttagcgggctagtacccagcctcgtcgtcaagtacaacgatgtgcgaagcaatatagcctggctgtacagccatgagcgtagcagtgtcagcgtcaagttggaaaaagtgttctag

SEQ ID NO: 520 - protein, 488 aa, P. parafulva
MPHCYRSFVGIFFAVFFPSHAQSDQDTDLRLNQTIDYRATVEDRGFQQAPGTLSLLSVDGHTYQVGNNLDDLGRALYLSVQRQQWADVIFFRARYAALPDHDPMLLAYADGARARADGQLSQAEVDYRHLLALQPDFLPGQLELARVLFENRKDRESADAFSRIRSSLDPADTQNRGLLQSISSFTQALDRRGQWQGSLAVGPTWSNNLNRSSESRTTYRLASSEGVYVIERRMPKAVSGDGIDYEATLNKRAALSGHHGAYIRALAYGQAYKGQGKYNEDTLTAHAGYSYQNARNQYSLGPLFEFNRMGSDPMSTAWGLRGEWMHNLSATRLLKLEVEYKDLAYRGLYASAYNGSVTSTYATLWQAMPQQWLLFGGFDFTDRRAKNDVETYFQKGLRAGVAKEFGSGLSTVLFASWRTRQYAGFSAPLNARRHEEESGYTFIARAPRLAVSGLVPSLVVKYNDVRSNIAWLYSHERSSVSVKLEKVF

SEQ ID NO: 521 - DNA, 1470 bp, P. pelagia
atgacccgccatccattgcatctgatcctcattatgctactgctgctcggcagtgcggccatacacgccgctgaccaagacaccaccctgcgtctcaatcagcacattgaaggcaacgctaacgcacaggagcaggagttgctacaaggcgaactggatgaccaaccgaccattaccctcaatggcgaaaccctcgccatcggcaacaatgccaatgatctgggccgggcgctctatctttcgctcagccatcagcaatggcaggccgccagcgccttcctgctacgctaccgcggcctgcccaacgccgaccccatgttgctgcactacgccgacggcgtgctgcagcgcgttcgcggccaactaggcaatgccgagacacagttccgcgcactgctgcagcgccagcccgactttctgcccgggaaactggagctggcccgcgtgctgtttgaaaaccagcaggaccaggcagccgaaaccctgtttcggcagatccgcgccggcctgcccgcggacgacgcccacactctgggcgtacgcaccagcgtcgagcgctttctcgcagcactggatcagcgtcaggactggcaaggttcaatcaacctgggcccgacctgggtcgacaatctgaaccagagttcggaaagcaatacttgcctgctggccaccaacggcggcacctgtattgtgcgccgcaccctgcccgaggcgatcagcgccacaggcctcgattacgaggccaccctcaaccgtcgtgttgcgctctcgggccatcacgggctatacgcccgcgccctgctgtatggctacagctaccgcaactacagcgagtacaacgaaagcaccctgatcgccaatcttggctacagctaccgcagcgcgcgcaatcagtattcgctggctccctccttcgaaaccaatcgcatcggcaacgatggcatgtattccgcctggggcgcccgcgccgaatggctgcatcagctcagccgccgcagcgcggtaaagctggaagcgacctaccgcgacatgcgctatcaggacccgctgtaccgctacaacaacggcggcaacagcgcactctatgccactggctggcatgtgctttcgccgcgctggacgctgttcggcggcctcgatctgagcgaaaggcgcaccgaggagccggtctacggttatcagcagggcggcgcgagattgggtgccgcgctgaccctgcaaagcgggattcgcgccagcctgttcagctcgttccgacaccgcgaatacgccgagtacagcccactgctcggcgcccgtcgccgtgatggcgagactaatcacacgctgatcgtcagcttgccgggactagcttggcagggtattacccctagcctcagtctcaagcacaccgaagtgcgcagtagcgtcgactggctttactcctaccagcgcacccagaccagtttccgtctggaaaaactgttttga

SEQ ID NO: 522 - protein, 489 aa, P. pelagia
MTRHPLHLILIMLLLLGSAAIHAADQDTTLRLNQHIEGNANAQEQELLQGELDDQPTITLNGETLAIGNNANDLGRALYLSLSHQQWQAASAFLLRYRGLPNADPMLLHYADGVLQRVRGQLGNAETQFRALLQRQPDFLPGKLELARVLFENQQDQAAETLFRQIRAGLPADDAHTLGVRTSVERFLAALDQRQDWQGSINLGPTWVDNLNQSSESNTCLLATNGGTCIVRRTLPEAISATGLDYEATLNRRVALSGHHGLYARALLYGYSYRNYSEYNESTLIANLGYSYRSARNQYSLAPSFETNRIGNDGMYSAWGARAEWLHQLSRRSAVKLEATYRDMRYQDPLYRYNNGGNSALYATGWHVLSPRWTLFGGLDLSERRTEEPVYGYQQGGARLGAALTLQSGIRASLFSSFRHREYAEYSPLLGARRRDGETNHTLIVSLPGLAWQGITPSLSLKHTEVRSSVDWLYSYQRTQTSFRLEKLF

SEQ ID NO: 523 - DNA, 1482 bp, P. pelagia
atgccttgccgtttcagagccgtctggctgctgtcgctggcgtgccttgttgcgcctggagtctgggccgatgacgacgatacgcgctttctgcaggatcagacccgccgcagtatcgagcagaaggcccaggccgaggaggcgctggcagcgccgcccggtacgctgatgtatgaaggccagcgctaccaggtgacgagcacgctggaggcgctgacgccagccatctatgtggccatcaataccaaccagtggacgcagttgccggactttgtcgcccgttaccgtgagctgccggggcaccggccagcgctggcgaatatggcggaaagcctgctggcgcgcttcgatgggaattatccgctggcgttgcagcgcatggagcaggccagcggacaggagccggaagatgcccgtatccagctggagctggcgcgcctgtggtttgaggatcatcaggaaaagcgcgcagaggagggctttgccagggtgctcaatatgggcttgcccgagcaggcgcagatgctggtgcagcagtaccggcaggcaatggatattcgcgcgagctggcatggcagcgcggcggtgggggtcggctataacgataatatcaatcaggccaacggctattacagttgcctgagttcttttttcggtatttgctttttcgagcggaaaatgccggatccggttgagtccgggctggcgagctatgagttgtcattgcagcgccgatataacctggcgggtaatcacaacctgcaactgcggcccatgagttatggcacctattattccaaaaccaatccgtctgatacggcaaccatgcaggattacagcaccaacctggcacaactgcagatgggttatcagtacctgaatgcgcggaacagtatcagcgttatgccctatgcggagcattactaccgcaaccgtgccagcgaatatctggcgcagggcctgcaactggaatggcagcacacgttaagccgcaaatggcaactgagcaccagcctggataccaagcgttacgaatacaccagcaaggggcagcgcctgggggcggattatgaaatgcaccagtggggcgttacggctgcctatatgcctggcgtcaataccagcctgtacggcggtgtgaccctgacccggcgtaaatacgaggtggatcaggccagcagcaaggaatggggcatgcgcggcggcgtttaccacgcctttgccggtcgggctggcttttttgtcaatggcatgggcatctaccgggaaacccgcaacgacgcctacgacttcttccttggtgaacggcgctacgacaagcagcaggtgtatatcctcagcgccggggcgaacggctggaagatcgctggcctgaccccggagctgcgcgtgcgccatagcatcaaccacagcagcaatctggattgggcgttcggcttcaagcagacggagctaagcttgatgttgcgcaggaatttctga

SEQ ID NO: 524 - protein, 493 aa, P. pelagia
MPCRFRAVWLLSLACLVAPGVWADDDDTRFLQDQTRRSIEQKAQAEEALAAPPGTLMYEGQRYQVTSTLEALTPAIYVAINTNQWTQLPDFVARYRELPGHRPALANMAESLLARFDGNYPLALQRMEQASGQEPEDARIQLELARLWFEDHQEKRAEEGFARVLNMGLPEQAQMLVQQYRQAMDIRASWHGSAAVGVGYNDNINQANGYYSCLSSFFGICFFERKMPDPVESGLASYELSLQRRYNLAGNHNLQLRPMSYGTYYSKTNPSDTATMQDYSTNLAQLQMGYQYLNARNSISVMPYAEHYYRNRASEYLAQGLQLEWQHTLSRKWQLSTSLDTKRYEYTSKGQRLGADYEMHQWGVTAAYMPGVNTSLYGGVTLTRRKYEVDQASSKEWGMRGGVYHAFAGRAGFFVNGMGIYRETRNDAYDFFLGERRYDKQQVYILSAGANGWKIAGLTPELRVRHSINHSSNLDWAFGFKQTELSLMLRRNF

SEQ ID NO: 525 - DNA, 1554 bp, P. phenylpyruvicus
atgatatacccccatcttttaaaaaccctcaccacctctgctgttttatttactgcggcttatgcccccttaatttatgcagcagatgatccacaacctttagatgataatgatagatatgcagcagaaaaagagaccgctgataagcttctagaacttcaacgagaagatataaatgtgagtaaagctgcaccaactgctaatttatctacgtctgaaacacaaaatgcactaaacgaaagagggcagagatcaaaatctcagcgctataaccttgaagcacttaaagccgatccaatagcttttactaagttcttgaatgctgctttggctgctcaagatatggtcacagtcaaagaactgttacctcattacaaagcactcaatgtaaatgatccgctgttgattaagttcgctgatgctctagtgtatcgaagtgaagggcagcataagaaagccattgctatctacaaagatatgttggcagacaacccagacttccaccctgtgcgccttaatctggctcaagctttatatgcagacaaacaatacagtgtggctcatgaccagctgcaaaagctacgtggtgccgatattccagagccagttatggtcaatgtcgagcgtttaattcagcgtattgatgagcaggaacagtggcgatttaatgcatcagtacgatatgtatatgatgataatttaaatgatgttcctgatgttatgcctaatggttacagggctcctaaagaggagggtaaagggattcaagtatcaggcagtgccaataaacgttttaatttagataaaaacttttatgccgaagtagggggcaacgcaaccctaaaaggctactgggataatagtgaatacaatgactacctgcttacagcttcagcaggtgtgggttatgatgatgccaaaaatgacgtttcaatcagcccttttgtaaccaagcgtttttatagtgaggatccttatagcttgcgtaaaggtgttaatatcagtggctctcgctgggtaaaacccaagctcaaattgactgctagtagcatgtattcaaacgaaacgttcgatgatgaaagaaataaagcaagagagacagatgcactatttctaggattgaatgctttatatattaaagatgccaaagaatacttttacggcggtataggtaggtataataatgacgtaccagaacgaagcttcttaacctatgatagaaactcagttaacgtaggttggggacgagaatggacccaaggaatatcgaccatagcctcattgaactatggggttaaaaaatatgataatcctgcaggggacttttatggtgagggtttaaatttcttttataatacttacggcggtgagcctggttcaagccgtgaagataagacaacttcgttgggcttacaagtatggaagcgtgatttaacggtattgggtctaacccctcgtctagtatttgattacgagaagacttcaagtaacttcaaatattatgatgatcgtgatgacaagacagccactatattactgactaaatcgttttaa

SEQ ID NO: 526 - protein, 517 aa, P. plecoglossicida
MIYPHLLKTLTTSAVLFTAAYAPLIYAADDPQPLDDNDRYAAEKETADKLLELQREDINVSKAAPTANLSTSETQNALNERGQRSKSQRYNLEALKADPIAFTKFLNAALAAQDMVTVKELLPHYKALNVNDPLLIKFADALVYRSEGQHKKAIAIYKDMLADNPDFHPVRLNLAQALYADKQYSVAHDQLQKLRGADIPEPVMVNVERLIQRIDEQEQWRFNASVRYVYDDNLNDVPDVMPNGYRAPKEEGKGIQVSGSANKRFNLDKNFYAEVGGNATLKGYWDNSEYNDYLLTASAGVGYDDAKNDVSISPFVTKRFYSEDPYSLRKGVNISGSRWVKPKLKLTASSMYSNETFDDERNKARETDALFLGLNALYIKDAKEYFYGGIGRYNNDVPERSFLTYDRNSVNVGWGREWTQGISTIASLNYGVKKYDNPAGDFYGEGLNFFYNTYGGEPGSSREDKTTSLGLQVWKRDLTVLGLTPRLVFDYEKTSSNFKYYDDRDDKTATILLTKSF

SEQ ID NO: 527 - DNA, 1491 bp, P. plecoglossicida
atgcccaggcgtaatagcacacatttatttcatctattgtttacgttccctctcctggtagggatcaacacactgccattggccaaagccgccaatcaggacaccgaactgcgccttaaccaggccatcgaacagcgtgcagtctcacaagagcgtgcactgctggaaagcagcgtgccaaccggcccggatgcgccgctattggagttagatggccaatactatggcatcggcaataccgtagatgaactcggcgcagcggtttacctgtccatcgagcgcaaacaatggcctgctgctagcgactatctggcccgttacaccgctctacctgaacatgaccctatgctcattgcctatgcgcatggggcgctggcccgcacaaaaggcaacctcgaactggcagagtcttactaccgcgaactgttgacaatgcagtctgactttctaccgggccaacttgaattagcccgtgtgctgtttgagagccgcaaggatcgcgagtccacttcagccttccaacagattcgagcagagctcgatgcttcggatgcccgggcaatgggcctcggcagatccgtcgacagcttcctcgaagtgctggatgagcgcgaacggtggcatggctcgctcgcggtgggcccgatatgggccagtaatctgaaccagtcttcagaaggcgtccatacgctgtactcatttttcggccccttgacttacaagcagcccaaagccgtatctgcacagggcattgactatgaagccacgttgagcaagcgtctgcccgtcagcaaccaccatggcatttatcttcgctcgctgctgtacggccagcactacaaaaacacaagcctgtataacgtgagcacgctgaccaacaacatcggctacagctaccacggcccccgtgaccaatacgcattcggccctacattcgaactgaacacgcacggcgatgaaaccttgtacaaggcctgggggctccacggcgaatggcagcgcgtactgtcgagcacgcgcatgttcaagctagagggcgattacaagaaaattgccttccagcaaaccgtccatgattacctgaacggtaatatgagcacactcttcgccacactttggcaagcgctaccttaccagtggatgctgttcggaggcggggatcttgctgtccgcaatacccagtatcgaaccaacgattacttccagaaggggctgcgcctcggcgtcgccaaagaattcgacatgggcgtcagcgcggtgttgttcacgtcctaccggcagcgccagtatgacggctacaacgcttggttgggggaccggcgcaatgaagatgagcaaagctatacgctctcggtgcgcgcaccccgcttagcaatatacggtgcggtgcccagccttaccgcgaaatattaccaaaacaaaagcaatatcgactgggcctactcttacgacaacaacagcgtctctctgaaactcgaaaaacaattctag

SEQ ID NO: 528 - protein, 496 aa, P. plecoglossicida
MPRRNSTHLFHLLFTFPLLVGINTLPLAKAANQDTELRLNQAIEQRAVSQERALLESSVPTGPDAPLLELDGQYYGIGNTVDELGAAVYLSIERKQWPAASDYLARYTALPEHDPMLIAYAHGALARTKGNLELAESYYRELLTMQSDFLPGQLELARVLFESRKDRESTSAFQQIRAELDASDARAMGLGRSVDSFLEVLDERERWHGSLAVGPIWASNLNQSSEGVHTLYSFFGPLTYKQPKAVSAQGIDYEATLSKRLPVSNHHGIYLRSLLYGQHYKNTSLYNVSTLTNNIGYSYHGPRDQYAFGPTFELNTHGDETLYKAWGLHGEWQRVLSSTRMFKLEGDYKKIAFQQTVHDYLNGNMSTLFATLWQALPYQWMLFGGGDLAVRNTQYRTNDYFQKGLRLGVAKEFDMGVSAVLFTSYRQRQYDGYNAWLGDRRNEDEQSYTLSVRAPRLAIYGAVPSLTAKYYQNKSNIDWAYSYDNNSVSLKLEKQF

SEQ ID NO: 529 - DNA, 1431 bp, P. pneumotropica
atgaaatccggtaagatttttctttctaccctttatatattgtttgctatcaatgcttcggcagaagtggctcaatctaaaagtgatgggctggacgatcgcattaatatggcaaaaccaaaacttccacaaacagaggcacaaatttctacaccaaagagagaaaatatttcaatgagcagtgccgaactacagcagcatcccaatttaatcattcgtggattagttccagccgtcttacaaaataatgcgaaagccgtagaaattttactcccgttttataaaaacttacctaatcaggatcccactttattagcttggtctgaatcaattctagcacgtcatcaaggaaatttttctctggcagccgagcgttatcgaactttatttagtcagcattcgcatatcatcgccttacgttatcagttagcacaagccttatttttaaacaatgataatgaagcagcaaaagatcaatttcaaaaattacgtgcggaagatatctctccggaaagcattcaaattattgatcaatatttatctgccttaaacaaacgtaatcaatggaaagtaaatggcgggatcagttatttaaatgaatcaaacatcaataacgcccctaaatccggcacaaaaattggtaattggaacgcttgggaaaaagaaagtgcacaaggtttttcctactatttgaatggagagaaaaaatggtcttgggcgaataatgtattcacaaaattgcaacttgaagggcaaggtcgatatttttggaataacagaaaatacaatgagttaaatcttcgcgtaggagcaggtttaggttatcaaactgcacgttttgaaaacttactcaccccctttacagaaaaacgttggtatggcggtggctcatcgggtggtgatgcattaaaacaatatgctaaaaattccggtatacgattagaaacaaactattggttaaatgaaaaatggcaaatttcgaccgcacttgagtatggtgaacaacgttataactggcgaaaacatttaaatggcaataattacctttggtcaaacaccttactttatactccacaaagcgggcaatactggcttataggcatagattataaccgtgaaaatacacgagaccatgataacgcttatcaacgcaaaaatattcgtctcgcttggggacaagaatggtcattaggtatttcctcccgtttaaatcttgcttatgcaaggcgaacatataaggatattgatttctttcagattcgtcagaaaaataatgagtattttactgcattgaccttatggcatcgcgatttctattttttggggattactccaaaactgacgtggacttatcaaaaaataaaaagcaatcatcctttttatcgttatgataaaaaccgcatttatttagaaatgagcaaaatattttaa

SEQ ID NO: 530 - protein, 464 aa, P. pneumotropica
MLFAINASAEVAQSKSDGLDDRINMAKPKLPQTEAQISTPKRENISMSSAELQQHPNLIIRGLVPAVLQNNAKAVEILLPFYKNLPNQDPTLLAWSESILARHQGNFSLAAERYRTLFSQHSHIIALRYQLAQALFLNNDNEAAKDQFQKLRAEDISPESIQIIDQYLSALNKRNQWKVNGGISYLNESNINNAPKSGTKIGNWNAWEKESAQGFSYYLNGEKKWSWANNVFTKLQLEGQGRYFWNNRKYNELNLRVGAGLGYQTARFENLLTPFTEKRWYGGGSSGGDALKQYAKNSGIRLETNYWLNEKWQISTALEYGEQRYNWRKHLNGNNYLWSNTLLYTPQSGQYWLIGIDYNRENTRDHDNAYQRKNIRLAWGQEWSLGISSRLNLAYARRTYKDIDFFQIRQKNNEYFTALTLWHRDFYFLGITPKLTWTYQKIKSNHPFYRYDKNRIYLEMSKIF

SEQ ID NO: 531 - DNA, 1458 bp, P. pneumotropica
atgaaaaaatattattctattttggtaggcatcttgttttgtgtaggcggttcaagcgtgtcggcaagtgccaatatgcaagagcaggacgcactcagattgtggcgactgtatagtcagcaatccgcccaacaacggcaggaacaaaatattgatagtgaacaaccgactaacgaaatcaccctagagggcgaatcttttcaggttgaaaacaacgtggaatctgtggggcaagcgctctacatcgcattaaatcgccaactatggcgatatgccaagcaatttttggctcaatatgaaaaatttcccgatcacaaagtccaattagcttggtttgccaaaggggcattagccagagaacaaggcgatttacccgaagcggaacgttattaccgcaaattattacaaagcgaaccggatttcttgcgtggtcaattggatttagcccgaattttgtttgaagacaaaaaaaacacagaatcgaccgcactttttcgccaactttcacaccaccccttaccggatggcgtattattaaccattcaggattaccaacaagcgctcaaagaacgggaaaattggaatagctcgctcactttaggttatttgtatcataaaaatttgaaccaatcttcgcaacgccagctatgcctattggaaaaagaggggcaatgttttattaaccgccgttcgcctgatgccataaatacttatggttggcgttatgatttcactgctcaacgacgtatttctttacagaatcatcatggtttggaattttattttaacggctacggacaattttatccccgtcatcacgactatgatgagaataccgttaaactttatggtggatacagctttcgcaatgctaaaacagagatcactgctgcaccgatactggaatatagcacctttggtgatcatcgttattatcacggttggggaactcatcttgagtggacgcaaaacatttcaccacgccacagttggaatacccaatttgaatataaaaaactgcgttacagcaagcattacagtgcatttgataaaactgatgtcagtacattattcggtacttggtattatctacttactccgcaaacaaccttatttgccggcgcagatttgtcatatcgacatacaccggatgatacgcaatcctaccgtatgttaggtgcccgtttgggattaaattatcagtttgattttggtttaaatgcaacggttctcgcattatggcgaaattataattaccaagtctatcacgcggctcttgagctgaaacgtaaagatagacaacaaatttatttagccatattaaaaataccaagctggaattttaaagacatcacgccttatctactgctgaaacacacccgtaataagagtaatgcagattatgtttatagttataaacaaagtgaaatacagctgaattttgagtggagattttaa

SEQ ID NO: 532 - protein, 485 aa, P. pneumotropica
MKKYYSILVGILFCVGGSSVSASANMQEQDALRLWRLYSQQSAQQRQEQNIDSEQPTNEITLEGESFQVENNVESVGQALYIALNRQLWRYAKQFLAQYEKFPDHKVQLAWFAKGALAREQGDLPEAERYYRKLLQSEPDFLRGQLDLARILFEDKKNTESTALFRQLSHHPLPDGVLLTIQDYQQALKERENWNSSLTLGYLYHKNLNQSSQRQLCLLEKEGQCFINRRSPDAINTYGWRYDFTAQRRISLQNHHGLEFYFNGYGQFYPRHHDYDENTVKLYGGYSFRNAKTEITAAPILEYSTFGDHRYYHGWGTHLEWTQNISPRHSWNTQFEYKKLRYSKHYSAFDKTDVSTLFGTWYYLLTPQTTLFAGADLSYRHTPDDTQSYRMLGARLGLNYQFDFGLNATVLALWRNYNYQVYHAALELKRKDRQQIYLAILKIPSWNFKDITPYLLLKHTRNKSNADYVYSYKQSEIQLNFEWRF

SEQ ID NO: 533 - DNA, 1365 bp, P. pnomenusa
gtgctcggtgccgttctgacgcatggcgcgtatgccgcgggcacgctcgtcgcagacggcactgccgctgtcggcgggccgcctgcctcgccgtccgacgcgggaaacgccgcgatctccgaggctcgcgcgctgatgcgcgccaaatcgcccgcacgggcctacgcgttgctggcgccgctggagagccgtctggcgggcgacggcgaatatgactacctgctgggtatcgctgccgcggacagtcatcacctcgaggttgccgagcgcgcactcaaacgcagcgtggcggcccgtcctggcgatggtccggctcacctcgaactggcgcgcacctattttctgctcgggcagcgcgataacgcgagacgcgagttcgagggggtggccgcgggcgaggtccccgagggtgtgcgtccggtcatcgaggcctacctgaacgcgatcaatgcgcctgcgggcgcgcgtacgtcctggaccggctacgtgcagggcaacgtcgggcacgataccaatgccaacaacgcgacgacgaattccgcgatcgcgattccggcactgggcggcttgatgttcgtcctcgacggcgcctcgcgcggaacgccggcgaacttcggcgacatcagtggcgggctaggcgtgcgacatgccgtgacggacaacctggtggtgtcggcatcgggagaggtcgatgtgcgcacctacgccgataaggcgcgcgccttcgatcagggcagctatttgcttcaactgggcgcgaactggttgtccgggccgaacaatttcggacttcagtacgccaaccagcacatgtgggtcgattcggagagctaccgcaatctcaacggcttcaccgcgcagtggacgcgcgatcttggcagcgaccttcaggtggcgacgttcgcgcagtacacgccgattcgctacatgggcacgaatgcgcgcgacgtgaatcgcgccatcgttggcgcgtcgatcgtcaagggattctcgtcggtctatggcgcgccggtcgcttatgcctcgctgtacgcggggcgagaaaagcccaaggacgacttgtccgccgcgttcggcaatcggctgtggggcgcgcgactcggtggcgaatggcacgtgatgccggatcaactgctgttcgccagcgctagcatcgagcgacgcaactacgacacgctcgacagtttgtttctcgtggagcgcagcgaccgtcagcttgatgtgagggctggctattcgtacttcgtgacgaaggcgttttcgatcacgccgcaattcagcttcactcggaatggctccagccagccgctgtaccagtaccaccgaagtgtctacgaggtcgtggctcgctatgacttccgctga

SEQ ID NO: 534 - protein, 453 aa, P. pnomenusa
MLGAVLTHGAYAAGTLVADGTAAVGGPPASPSDAGNAAISEARALMRAKSPARAYALLAPLESRLAGDGEYDYLLGIAAADSHHLEVAERALKRSVAARPGDGPAHLELARTYFLLGQRDNARREFEGVAAGEVPEGVRPVIEAYLNAINAPAGARTSWTGYVQGNVGHDTNANNATTNSAIAIPALGGLMFVLDGASRGTPANFGDISGGLGVRHAVTDNLVVSASGEVDVRTYADKARAFDQGSYLLQLGANWLSGPNNFGLQYANQHMWVDSESYRNLNGFTAQWTRDLGSDLQVATFAQYTPIRYMGTNARDVNRAIVGASIVKGFSSVYGAPVAYASLYAGREKPKDDLSAAFGNRLWGARLGGEWHVMPDQLLFASASIERRNYDTLDSLFLVERSDRQLDVRAGYSYFVTKAFSITPQFSFTRNGSSQPLYQYHRSVYEVVARYDF

SEQ ID NO: 535 - DNA, 1473 bp, P. putida
atgccccagccttcacgcctgcattacgtcttgttgctgtccctcccgctttctttccccctcactgctttggccgaccaggacaccaacctgcgcctgaaccagagcattgaataccgcgccaaccgtcaggagcgagagctgctcaaggacgaaatcgctggcacgacgctggtcatcgatggccagacgtaccgggtagagaacaaccttgatgacctgggccgtgccctttatgtttcggtgcagcgccagcaatgggcggctgtgactgcattccgcgcccgctacgtcgcgctgccaggccacgaccggatgctgctggcctacgccgatggcgcattggctcgctcgcgtggcgacttggagcaagccgaggcgcactaccgccagttgttgacgttgcagggcgactttctccccggccagctcgaactggcccgggtgctgttcgaaaaccgcaaggaccgcgagtcggctgaggctttccgtcagatcagccaaagcctgggcccagccgatgcgcgcaaccagggcctgggcaataccgtcgacagtttcatcgaggcgctggaccaccgcgaaagctggcaaggctcgcttgccatcggcccgacctggaacgacaacctcaaccagtcctcggagagcaccacccactaccgcctggaaaccagtgacggggtgtacctggtcgagcgcaagatgcccaaggcagtgtcggcacaaggcatcgactacgaagccacactgaacaagcgcgtagcgctgtccggccaccatggcgtattcggccgggcgctcgcctacgggcaggcttacgacaaagagagcaagtacaacgaagacaccttcatcggtaacaccggctacagctatcaggacgggcgcaaccagtacagcctgggcccacagttcgaatacaaccgcattggcagtgacccgatgtactcagcctggggcctgcgcggtgaatggatgcacaacctttcggccacgcgcatgctcaagctggaaggcgaatacaaggacatggcctaccgccgccaggccgcggacacctatgacggcagcgcagcctccgtgtacgccactttgtggcaagccctgccacagcagtgggtgctgttcggcggcttcgacctcaccgaccgcaacacccgcgatgctaccgaagcctacttccagaggggcctgcgcctgggcgttgccaaggacttcgacatcggcctgagcactgtgctgttcgcctcctggcgcacccgccagtacgacgcctacagtgccttgctcgatgaccggcgtcatgaagaggagcagggctatacctttatcgtgcgcgcaccgggcctggccttccacgacctggtacccagcctgaccttcaagtacaacaaggtgaacagcaacgtcgactggctgtacagctgggagcgcaacagcgtcagcctcaagctggagaagcagttctga

SEQ ID NO: 536 - protein, 490 aa, P. putida
MPQPSRLHYVLLLSLPLSFPLTALADQDTNLRLNQSIEYRANRQERELLKDEIAGTTLVIDGQTYRVENNLDDLGRALYVSVQRQQWAAVTAFRARYVALPGHDRMLLAYADGALARSRGDLEQAEAHYRQLLTLQGDFLPGQLELARVLFENRKDRESAEAFRQISQSLGPADARNQGLGNTVDSFIEALDHRESWQGSLAIGPTWNDNLNQSSESTTHYRLETSDGVYLVERKMPKAVSAQGIDYEATLNKRVALSGHHGVFGRALAYGQAYDKESKYNEDTFIGNTGYSYQDGRNQYSLGPQFEYNRIGSDPMYSAWGLRGEWMHNLSATRMLKLEGEYKDMAYRRQAADTYDGSAASVYATLWQALPQQWVLFGGFDLTDRNTRDATEAYFQRGLRLGVAKDFDIGLSTVLFASWRTRQYDAYSALLDDRRHEEEQGYTFIVRAPGLAFHDLVPSLTFKYNKVNSNVDWLYSWERNSVSLKLEKQF

SEQ ID NO: 537 - DNA, 1500 bp, P. rettgeri
gtgacaggcagttggccactgcctattattaccgaagctaatcctatgcgatatctgttattaacccctgccattatgatgcttatagccgcattctctgcatttccagcaagcttggacactgaccgagaacaattgttatggcaaaaagacaaacaaaactatcgtgataaaagtgcagtagtccccaataaagaccaattacttctcccagatgacctatcaattaacttaaatggggaaaattatgcccttgagaataatgcccaagacctcgggcaagccatttatctggcaattaaccacaggcaatttgaagacgtacagcgcttattaccccgctaccaacaactagctgatgcggatccactactcattttatttgcaaaagcagaaattgctaaatcgcaaaatcattaccctgaagcgattgcccactaccaacaaatattggcacggtcgccaaagtttcttcgcataaaattagaactggcccgggcttatttcgaagataaccaaaataaagagtctttggctttattccaaaatttaatcaacgatgaaacactcgcattacctacgaatgtgaagcaaaccatccaacaatttattagtgctatcgaaaaccgcacagcttggactggaagtctctcctttggctataaatacaacagtaatatcaaccaagttccagataaaaataaagtttgggaaacgccagggggaacctggaaaatggctaaccccaaatcatcaccgggactcacctatgatgcaagtctgagtaaaattattcctatctcgggcaatcattccctgcaaatcaaggggacatcttatggtgaccgctatccgcactatgctgaattcagtgaaaacacgtcttctttagcaactttatatcgttttaatgatgcgaacaccactgtcgcattcggcccattagttgagttaaaaacggtcaatgaaaagcgccgttatttaggcatagggggaaaaattgaagctgactaccaattttcacctcgtgtgctcctaagtacctccgctgactaccaacaacttcattatcaaaaaccgtatgacagtgccaatggtaatcgaagtagcctacatctaaccggtgtctatggtattaccccagatacctccctctttttgggggctgatgcgactcgtctcaccacagaagttcgtagcgatgattatgaccaattgggtatccgaggcggcttttatcacgtgctaacacccgatattcatttactggcacttgcaacttaccgagaaagccaattcaaggccttcaaccaaatgttgaatgttaaacgccatgatagagaagcgatgtattttgcgcgtcttagttttccaaattattcattgctcacatttacgccttataccagttaccgctttcgtgataaccgcagttctgcagatggaatttactcctaccaccagcacgaaatttctattggattagaaacccgtttttaa

SEQ ID NO: 538 - protein, 499 aa, P. rettgeri
MTGSWPLPIITEANPMRYLLLTPAIMMLIAAFSAFPASLDTDREQLLWQKDKQNYRDKSAVVPNKDQLLLPDDLSINLNGENYALENNAQDLGQAIYLAINHRQFEDVQRLLPRYQQLADADPLLILFAKAEIAKSQNHYPEAIAHYQQILARSPKFLRIKLELARAYFEDNQNKESLALFQNLINDETLALPTNVKQTIQQFISAIENRTAWTGSLSFGYKYNSNINQVPDKNKVWETPGGTWKMANPKSSPGLTYDASLSKIIPISGNHSLQIKGTSYGDRYPHYAEFSENTSSLATLYRFNDANTTVAFGPLVELKTVNEKRRYLGIGGKIEADYQFSPRVLLSTSADYQQLHYQKPYDSANGNRSSLHLTGVYGITPDTSLFLGADATRLTTEVRSDDYDQLGIRGGFYHVLTPDIHLLALATYRESQFKAFNQMLNVKRHDREAMYFARLSFPNYSLLTFTPYTSYRFRDNRSSADGIYSYHQHEISIGLETRF

SEQ ID NO: 539 - DNA, 1371 bp, P. rettgeri
ttgttattgtttttccctctacactcaatacaggcagttcaagatgtaaacgaagaggttactaatgatctaagtggttatagtaacaaaaaacatcaatcagaaataaataatgtaaaatatagtaaaaaaaatatcgacgagcttggctttattctttatgatctaattcagcagagggattttgatgtaataaataaaatcattgataactatgttagtcataaagaccatgataaagaattggttaaatatatttactctgaaaaggcgatgttaaataatgaatataacttggcaatcaggttatataatgaaattttaattcacaagcctaatatgcttttggttgagttaaaacttgctcgagcactaacttatgttaaacattatgaggcagcattatcgatatatcaaaatataaaaacaaaatatagcgggggaatatcaagtaagttagttgaatatattgaaaataaaataatatatttagagaataaaaatcgctggcaaggaatggttaagctaggttcaagttatgattttaatttaaatgaagcatcaaatagccgtgaaatgtactgttttcgtagtaaatgtatgaatagcagcaatcagtctattgcaggtggaaaatggcattattacattaaatcaacaaagcgttttcctctcgtgggtaaccattcagggctattatcatttggtgcgtttgggttagaaccgatgaaaacagtcacggctagaaaaataaatatatttattagcgggggttatcaatttgagaatgcgaatacaaaaatcggcatattgcccatatttgaagccaaatggcatgataaccaatattataatttaagcctaggaggaaaaatagcaacagaatatacgttaaatcatcgagtaactattttaggtgattttgaatataaaaataaaacgcatcctcatgagtatagttttaatgatggtgataaatggatctattcactatttgggacctatttagttgattctcagttagtcgcttttggaggaatacatggagccaatcgggaaaaacaacgcaatagtgatagttattcacagtatgggattagagccggttttttaaaggtcaccggactgtgtgattttcttgttgcggtaggttacaaacaaacaaatttcgaacagtttgatgtgtatttaaatgtaaaaagaaaagatcaaaatagatatttaaatgcccaagtgacatttgataaaaataaaatattaacctttacaccttctatttattttaatagccaagtgaataaaagcacggcagatattatttattcttttaagcaaagtgaagtcggtgtcaatttcaccaagaaattttaa

SEQ ID NO: 540 - protein, 456 aa, P. rettgeri
MLLFFPLHSIQAVQDVNEEVTNDLSGYSNKKHQSEINNVKYSKKNIDELGFILYDLIQQRDFDVINKIIDNYVSHKDHDKELVKYIYSEKAMLNNEYNLAIRLYNEILIHKPNMLLVELKLARALTYVKHYEAALSIYQNIKTKYSGGISSKLVEYIENKIIYLENKNRWQGMVKLGSSYDFNLNEASNSREMYCFRSKCMNSSNQSIAGGKWHYYIKSTKRFPLVGNHSGLLSFGAFGLEPMKTVTARKINIFISGGYQFENANTKIGILPIFEAKWHDNQYYNLSLGGKIATEYTLNHRVTILGDFEYKNKTHPHEYSFNDGDKWIYSLFGTYLVDSQLVAFGGIHGANREKQRNSDSYSQYGIRAGFLKVTGLCDFLVAVGYKQTNFEQFDVYLNVKRKDQNRYLNAQVTFDKNKILTFTPSIYFNSQVNKSTADIIYSFKQSEVGVNFTKKF

SEQ ID NO: 541 - DNA, 1464 bp, P. sneebia
atgcaaatcgcgcccttattttccataataataattttcatttcctctttaatgccattaactctctattccgctaatatagatactgaccgagaattattattatggcaaaaagaacaacaaataaatcgagaaaacaataataatattcctgataaaaaccagtcattattacccgatgatgccatattaaaattagatggaaaaacctattctgtaaaaaagaatattaatgatttaggtaaagcgatttatttatctattactcaacatcaattcgatgatatacaacaattactcaatcattatcaatatttccctgatcatgacccattattagttttatttgcgcatgctgaaattgaaaaatataataatcattattctcaagccataaactattatcgagagatattagaactatcgccaaattttttacgtgtaaaactagaattagctcgtacttattttgaagataaacaaaataatgaatcgttaaagatatttaataatatcattaatgatactgcacttttattacctgaaagtactcgccacattattcaaaaatttattattactttagaaaaacgcattagctggtctggtaatttctctgttgcttatacctataatagtaatattaaccaaacaccaaagaagaataagatatgggaaatacccggtggagtttggcaaactgaagcacctattgcttatggtggactttcttatgatgccagtttagataaggcgattcccctctttggtcatcactccttacagattaaagcgtctagttacggcgaccattacccacactatgcagaattcagtgaaaacacctcaactttagcgaccctatatcaatttaacaatgcggataccacattatcatttggcccgcaaattgagctaaaaacgatagataatcagcaccttcatactggtattggcctacgaatagagagcgattatcagttctctccccgttttatggtaagtgcttctgccaattatcattggcttaattatcaaaaaacttatgccggcagcgatggatctcgcagcaacttattactcacgggaatttatggtcttaccacagatacatcactttttttaggtacagatgccactcaagttactacccaaacccgcagtgatgattacgaccaattaggattaagaagcggtttttttagtgtgttatctcctgatattcatttgctaacccttgccacactgcgctatagccaatttcaagctttcaactcaatgctgaatgtaaaacgtgatgatcgcgaagcaatgctatttacacgtttaagttttccgggctattcagtgctcacattaacaccctacaccagttaccgctttcgcgataaccaaagctccgctgatggaatttattcttatcggcaacacgagttttcagccggatttgaaactcgattttaa

SEQ ID NO: 542 - protein, 487 aa, P. sneebia
MQIAPLFSIIIIFISSLMPLTLYSANIDTDRELLLWQKEQQINRENNNNIPDKNQSLLPDDAILKLDGKTYSVKKNINDLGKAIYLSITQHQFDDIQQLLNHYQYFPDHDPLLVLFAHAEIEKYNNHYSQAINYYREILELSPNFLRVKLELARTYFEDKQNNESLKIFNNIINDTALLLPESTRHIIQKFIITLEKRISWSGNFSVAYTYNSNINQTPKKNKIWEIPGGVWQTEAPIAYGGLSYDASLDKAIPLFGHHSLQIKASSYGDHYPHYAEFSENTSTLATLYQFNNADTTLSFGPQIELKTIDNQHLHTGIGLRIESDYQFSPRFMVSASANYHWLNYQKTYAGSDGSRSNLLLTGIYGLTTDTSLFLGTDATQVTTQTRSDDYDQLGLRSGFFSVLSPDIHLLTLATLRYSQFQAFNSMLNVKRDDREAMLFTRLSFPGYSVLTLTPYTSYRFRDNQSSADGIYSYRQHEFSAGFETRF

SEQ ID NO: 543 - DNA, 1461 bp, P. stuartii
atggggttatttcgagcgggtatcctatggttgttactttatagtagtgtcgccatcggagagataagtgatattgataattatcgctttttattaaaagataaagcggaatttagtcgaaaatctcccgttattgaaaataataaaccgtttattaaagatgacatcaaaattaatttcgatggtaaagaatatcaggttagtaatacgcttaatgagatgggaatggctatttatattgccttaaatcgtgggcaatacgatgacgtagaacgtctattatcatattaccaacaattaagtggatatgacgttttacttgttgagtttgctaaagcacaaatggcacgtgcaaatcatgattatgctcaggctatttttcactaccaaactattttagcgctaaaacctgattttttgcgtgtcgagctggaattagctcgaacttattttgaagatcaacaaaataatgaggcatcttcacagtttaaacgggtattggaaaagtatcagcagcagttaccacaaagtgtattagctacaatttcacaatttattacggaattaagtaaacgaaatagttggtcaggaagtttttcggtaggttacggttacaactctaatattaatcaagtaccgggggataaaagacagcgttgctacagaaatgcagtgcagcagttttgttatagtgctggattggcggataaaggcaccaaatttatctatgatggtgatattaaacgtaccttttcactttaccagcatcacagtttactgtttaaagcatatacctatggcaataagtatgatggtgctgccgagtataatgaaaataccagccacatacgggtttattatcaatatcaggatgcaaaaaaatcattcgctattggcccaattagtgaatttaaatgggtaggagagcggcgacactattatggtgttggagtgggaatggaagcggagtatcgttttttaccccagttttcgctgagtacagtgattgatcaccaaaaaataaactatcgttcaccttatcaaagccaagatggtaataagagtcaggcttatatcacagggatttatgctcttagctcagatgcagtgatatttggtggtgtagatagtgggtatgtgaataaggtttatgatagtgacagttataaacaatatggcataagaggaggaatatttaaggacgttagtcagtattatcatctattggggatcgccagttataagcaaactcgatttaatgctccgcaatatgcgttgggaagtcaaaatcgaatggatgatgaacaactgtatttggctaagttaagtttacctaaatacagtattgccacaatgacaccatccatttcttataggtatagagtcaataaaagtaatattgatgcactgtattcataccaacaaagtgaaattgaaattagattagaaaaacgcttttaa

SEQ ID NO: 544 - protein, 486 aa, P. stuartii
MGLFRAGILWLLLYSSVAIGEISDIDNYRFLLKDKAEFSRKSPVIENNKPFIKDDIKINFDGKEYQVSNTLNEMGMAIYIALNRGQYDDVERLLSYYQQLSGYDVLLVEFAKAQMARANHDYAQAIFHYQTILALKPDFLRVELELARTYFEDQQNNEASSQFKRVLEKYQQQLPQSVLATISQFITELSKRNSWSGSFSVGYGYNSNINQVPGDKRQRCYRNAVQQFCYSAGLADKGTKFIYDGDIKRTFSLYQHHSLLFKAYTYGNKYDGAAEYNENTSHIRVYYQYQDAKKSFAIGPISEFKWVGERRHYYGVGVGMEAEYRFLPQFSLSTVIDHQKINYRSPYQSQDGNKSQAYITGIYALSSDAVIFGGVDSGYVNKVYDSDSYKQYGIRGGIFKDVSQYYHLLGIASYKQTRFNAPQYALGSQNRMDDEQLYLAKLSLPKYSIATMTPSISYRYRVNKSNIDALYSYQQSEIEIRLEKRF

SEQ ID NO: 545 - DNA, 1479 bp, P. stutzeri
atgtcttgccgtttcagggccgtctggctgctgtcgctggcgtgcctcgtcgcgcccgccgtatgggccgatgacgacgatacgcttttcctgcaggaccagacccgccgcaccatcgagcagaaggcccaggccgaggaggcgctggcggcgccgcccggtacgctgatgtacgagggccggcgctaccaggtgccgagcaccctggaggcactgacgccggccatctacgtggccatcaataccaaccagtggacccagttgccggatttcatcgcccgttaccgtgaactgccggggcatcggccggcgctggcgaacatggcggaaagcctgctggcgcgcttcgagggggactatccgctggcgttgcagcgcatggagctggccagtgaacaggagccgcgggatgcacgcatcctgctggagctggcgcgcctgtggttcgagggttaccaggaaaagcgcgcgcgggagggctttgccagggcgctggaggcggggctgccgcccgaggtacagatgctgatccagcagtatcacctggcgatggaaatccgtgccgactggcatggcagtgcggcgctaggctggggctacaacgacaatatcaaccaggctaatggccactacagctgcctcagcgagttcgccggcatctgtttcttcgagcgcaggatgcccgaggccatcgattccgaaatggtcaactacgagctgtcgttgcagcgccgcttcaacctgtccggtaaccacaacctgcagctgcgtcccctcagctacggcaactactattcgacgaccgatccgtccacgacttcccgtatcaaggactacagcaacaacctggcgatcctgcaggcgggctaccagtacctggatgcccgcgacaatatctcgctcgctccctatgtcgagcactactaccgcaaccgtgccagcgactacctggcccatggcctgcaactggagtggagccactcgctgaaccgccagtggcagctgggcaccagcctggatgccaagcgctacgagtacagttccaggggcctgctgaccggtgccgactacgaccagtaccagtggaacctgttcgcctccttctcgcccagcacccgcaccagcctgtacggcggcttaagcctcacccgcaagaagtacgaggtggatcaggccagcagccgcgactgggccgtgcgcggcggggtctatcatctctttgccggcagcgccgggttgttcgtcaacgcgctgggcatctaccgggaaagccgcaacgatgcctacgatttcttcctcggcgaacgccggtacgacaagcagcaggtgtatatcctcagcgccggggtgaacgcctggcaggtcgccgggctggttccggagttgcgcgtgcggcacagcatcaaccacagcaatctggattgggcgttcggcttcgagcagacggaggtgagcctgatgctgcgcaagagcttctga

SEQ ID NO: 546 - protein, 492 aa, P. stutzeri
MSCRFRAVWLLSLACLVAPAVWADDDDTLFLQDQTRRTIEQKAQAEEALAAPPGTLMYEGRRYQVPSTLEALTPAIYVAINTNQWTQLPDFIARYRELPGHRPALANMAESLLARFEGDYPLALQRMELASEQEPRDARILLELARLWFEGYQEKRAREGFARALEAGLPPEVQMLIQQYHLAMEIRADWHGSAALGWGYNDNINQANGHYSCLSEFAGICFFERRMPEAIDSEMVNYELSLQRRFNLSGNHNLQLRPLSYGNYYSTTDPSTTSRIKDYSNNLAILQAGYQYLDARDNISLAPYVEHYYRNRASDYLAHGLQLEWSHSLNRQWQLGTSLDAKRYEYSSRGLLTGADYDQYQWNLFASFSPSTRTSLYGGLSLTRKKYEVDQASSRDWAVRGGVYHLFAGSAGLFVNALGIYRESRNDAYDFFLGERRYDKQQVYILSAGVNAWQVAGLVPELRVRHSINHSNLDWAFGFEQTEVSLMLRKSF

SEQ ID NO: 547 - DNA, 1539 bp, P. temperata
ttgtcttattttgtttatttattggtccaactattaagcagtgatattccgatgttaaatatccccattatccgttttaccatactgatcagttgcttgtttatttatccctctttggttctggcagatgaagatgctggcagaagattgtggcataacgtacagcgaaatttgcaggatcaagaaaaagaattcgttactgatgaaactgtaaatgagaatactgatcatttatcgatagtccttaatggtcagactttcagtgttgagaataatgtgaatgaggttggtcaggcgctgtatttagctattaatcatcaacaagtaaaggatgttgagcgttttttgtcgatgtatcagaagttacctaggcatgacatgcaattggtacattttgctcaggcgaatcttgcccgttcgcagggtaatttagtagcggcagaacagcattatcaggctattttgcaccagcaacctgattttacccgtgctaaattggagttagccagggtctattatgagaaccagaaaaataaagaggcaggtttactgtttaatgagatttctgcggcaaatcacgacaacgaaaataaattaccaccagcagtcattaagaatataaccagctatcaggatgcgattgaattgcgtaatgcctggcgtgggtcttttgccgtaggatatatttttaacgacaatactaatatgtcaccaaataagcctcctgtttgcaaggaatatgctgaaaatggcagttgtatagttgaacgtaagttgcctttggcaaagaaggcaaatggtatcagttatgatgctacgttacgtaagatatatcagttaagtggtcaccatggtatatccttgcgctcaatgacttatggtgaaagttatcgtcatcatagtgatgaaaatgaaaatacaacttccgcttatttgggatataactataaggcacagaaaaatgattttctgataggtccaattattgagtttaatcatgttggtaatcattctcgttatcgcaccacaggaatgaaaactgaatggatgaatattctatcaaaaaatctggcattgaatcttgaaggtgaatataaacagtttcgttatcataaactttataatcataatgacggtaatatgacttctgtttatgccaccttatcttattatttaactgatcagacaattacctttactggtggtgattgggttaataaaaccagtgttgagaaaacggatgattatcaacagaaaggcatacgagcgggtatttctacccagttgtatccgggaattaatgcggtggtatttaccgcattacgacagaggcagtttggagattacagtgtaccattaagtgcacgccgtaaagacaatgaacaactctattcggccatcctcagtatgcctaaatttgatgtttttggcttaactccggtaatcacttatcggtacagaaaaaacaatagcaatgtcgattggctatactcatataacaaaaacgaagtgttaattaagtttgaaaaatatttttga

SEQ ID NO: 548 - protein, 512 aa, P. temperata
MSYFVYLLVQLLSSDIPMLNIPIIRFTILISCLFIYPSLVLADEDAGRRLWHNVQRNLQDQEKEFVTDETVNENTDHLSIVLNGQTFSVENNVNEVGQALYLAINHQQVKDVERFLSMYQKLPRHDMQLVHFAQANLARSQGNLVAAEQHYQAILHQQPDFTRAKLELARVYYENQKNKEAGLLFNEISAANHDNENKLPPAVIKNITSYQDAIELRNAWRGSFAVGYIFNDNTNMSPNKPPVCKEYAENGSCIVERKLPLAKKANGISYDATLRKIYQLSGHHGISLRSMTYGESYRHHSDENENTTSAYLGYNYKAQKNDFLIGPIIEFNHVGNHSRYRTTGMKTEWMNILSKNLALNLEGEYKQFRYHKLYNHNDGNMTSVYATLSYYLTDQTITFTGGDWVNKTSVEKTDDYQQKGIRAGISTQLYPGINAVVFTALRQRQFGDYSVPLSARRKDNEQLYSAILSMPKFDVFGLTPVITYRYRKNNSNVDWLYSYNKNEVLIKFEKYF

SEQ ID NO: 549 - DNA, 1362 bp, P. vulgaris
atgaattattatcaactcttaactagagggttactggctttattgcttattttattttcatttaatgggagtgcaaaagagagccgcgacaaactactttattatcttgaaacaacgagtacagctaaagtaggtcagcaactttatcactatttgcaacaacaacagtggcaaaaagcagaaagattactgctttattatcaacaacaacctcaacatgaagcattacttgttaattacgcaaaggcgttattggcacaaaacagaggtgattttttaaacgctgaattttattatcagcaacaacttaagcaaaaagccgattttatcccagctcaaactgggctaattcaactttactttcatttacgagaatataaaaaagcacagcaacaacttaatcaactgagcaatattattgatttatctaaagatattatccagtctattgagttttataaggttaagttagcctcttattttcaaggccaacgtttctatcaacttggctttttctatgacgataatattaatcatgcaccttacttatctgaaaaaattgtctctcaatccactcaaggaaaaacgacgctaagaggtgcaaaacctattgcatctacaggaattactcattatttttctttttatcaaccttttattatttattcttactatactttttcttcttatacttatgctagatatatagattatcactctcatcgtaacgccaatttttttgcattatatacacaactgggttatcgctatcaaaaacctcaatatcagtggtcaataacaccttattacgaaataaaatcatcacgggaacaatatgaatatcaagcatggggaaatgaaacacagctttcttattttattaataaaaagcaaactattaatttaagcttggattataaaataaagaaatatcaaaaaacgttaaataatttaaatagtaagcgatttagttatagtgcttaccataactattattttaataataaaatacacttagttaatcaattaaattatcagttagttcgtaaaaaaaacactttattaaattatcatctgtatggtataaaaactggtatttattatccattgtcagctaattggcatatctctctttttttacagtatcaatttaaatattttaataactataatcctttattaaaaaagagaagaaaagataatagtattatttttacaaccaatattaaaagcaaatcaccttttgttttagggttttatcccacaattgaattacgttatacccgaagattaagcaatgtggattggttatatcaatatcagcaacatgaagtgttatttaaattagaaaaacaattttaa

SEQ ID NO: 550 - protein, 453 aa, P. vulgaris
MNYYQLLTRGLLALLLILFSFNGSAKESRDKLLYYLETTSTAKVGQQLYHYLQQQQWQKAERLLLYYQQQPQHEALLVNYAKALLAQNRGDFLNAEFYYQQQLKQKADFIPAQTGLIQLYFHLREYKKAQQQLNQLSNIIDLSKDIIQSIEFYKVKLASYFQGQRFYQLGFFYDDNINHAPYLSEKIVSQSTQGKTTLRGAKPIASTGITHYFSFYQPFIIYSYYTFSSYTYARYIDYHSHRNANFFALYTQLGYRYQKPQYQWSITPYYEIKSSREQYEYQAWGNETQLSYFINKKQTINLSLDYKIKKYQKTLNNLNSKRFSYSAYHNYYFNNKIHLVNQLNYQLVRKKNTLLNYHLYGIKTGIYYPLSANWHISLFLQYQFKYFNNYNPLLKKRRKDNSIIFTTNIKSKSPFVLGFYPTIELRYTRRLSNVDWLYQYQQHEVLFKLEKQF

SEQ ID NO: 551 - DNA, 1266 bp, Phyllobacterium sp. YR531
ttgagtttctttggggctgagccaacgcatgccagcgttcaacagggtccctcttattcttttgcgcaagtcagggcgttgatcgaagcatcagagtatgacgaggctcgcaatcttgttgcgacttctggtgatggtgggaaagccaatcaagttgcccagatatttactgaagcgcttatactgaagcatcagaggcagtttcaggcatctgctgagaagatgcagcaaatcattatcgcttatccacaatatgacagggtgcgccaggaattggcgcatacctacttcctgttaggtgatggcgagcacgcaaaataccaattcgaattgctggcggcatcaagccagtctccagacttccggtcgctttataataactatatcgacgctatagatgcaaagcgcccttggactcttgatggttatattgcactggcacccagtacgaatattaccagaggcgcaagcgaagacactattttcatagcgggcatccccttcactccaaagaatcagaaacaaagtggtgttggtctcaactacggtgtttcgggaacttatcaattcaaactggatgagcggttcgccttggcatttggcgggagcttggacggcgttaaataccgtgatcgggcctttgacgagctgtcaggacaagtcttttcagaactttcttataggactcatgattggcgtttcggtattggaccaacccttgcgcgaacctcttttgcgtgggaggggcataattggggttatggcgtccagggatatgttcagaagcggctaggcaacagcggtgacaccattcggatgacggcccgtatgcgttatctggattacgatgttcaggattaccatgatggtgtggaaacgaccattggccttcgatatcagcacgtgttttctgcttctttactggccagtgtcggcgctaccgcgacgcggatgaatgcccagaactttaacgcctatacaagcatccgccccaatttagaagtttactccgatctaccattgggtattcttggtagtgttgcggcgggatatgagttccgaaactttgacggcaaatttcccatgactggcaaaggaagggaggacaggcagttcagcgcgagtgttggactgacactgagaaagctgagttataaaaatattgcgccccggctggaatatggttatcgcatcaatagctcgaatgttgatctctacgattacgattcgcacaattttggaatttatctgacgaagaagtactag

SEQ ID NO: 552 - protein, 421 aa, Phyllobacterium sp. YR531
MSFFGAEPTHASVQQGPSYSFAQVRALIEASEYDEARNLVATSGDGGKANQVAQIFTEALILKHQRQFQASAEKMQQIIIAYPQYDRVRQELAHTYFLLGDGEHAKYQFELLAASSQSPDFRSLYNNYIDAIDAKRPWTLDGYIALAPSTNITRGASEDTIFIAGIPFTPKNQKQSGVGLNYGVSGTYQFKLDERFALAFGGSLDGVKYRDRAFDELSGQVFSELSYRTHDWRFGIGPTLARTSFAWEGHNWGYGVQGYVQKRLGNSGDTIRMTARMRYLDYDVQDYHDGVETTIGLRYQHVFSASLLASVGATATRMNAQNFNAYTSIRPNLEVYSDLPLGILGSVAAGYEFRNFDGKFPMTGKGREDRQFSASVGLTLRKLSYKNIAPRLEYGYRINSSNVDLYDYDSHNFGIYLTKKY

SEQ ID NO: 553 - DNA, 1335 bp, Polaromonas sp. CF318
atgtattcaaaaaacaaacttttctcgggcggggtcactgttcttctcgccatcctggccaacggcctagcgcacgcggaagtcgacgcactggtcagcaacgcccgtagtctgctggaccaaagccaggcgcaaaaagccttcgatctgctggagccgcaagaggcggcgcgcgcgggcgacccggacttcgacaccgtgctgggcattgccgcgaacgagaccggccagtacacccgcgcggtattcgccctggaacgcgtgctggccgtgcagcccagcaactcccgggcacgtgccgaactcggccgcgcgctgttctccgtcggtgacaccaaggcctcgcggcaagtgctgctggaaaccaagcaggacaacatccctgccgaagccgccgccaccatagaccagttcctgcaggccatagaccgcaccgaagaagccgcccgctcgtcggtcaagcccttcctggaagccagcataggttacgacaccaacatcaacagcggccccggcaacccgaatgtggccgtgcccgctttcggcggcctgatcttcacgctcaatcccgccggcgtcgaaaccaaggacgcgttcatgagcctgggcggcgggctgtcggcccgctatgtggtcgacccgcgctggtcgctgatcggcaacgtctacggcaacgcgcgcgtcaacagcaaatacaacgacttcaacaccggccaggtcgatgtcaatttcggcgccagctaccgctacgacaaacacgagttctcgggcgtcgtgcaggccgggacttacaccgtggccggctcgcgcgcccgcgaccagcaaggcctggtcggcgaatggacctaccgcatcgacggatttcgccagtggagcacctacatccagtggggcgacctgagctaccccggccagtcgctgcgcgacgcgacgcgcacggtggtcggaacctcctatgcccacgccttccgcgacagcaacatcgtggtcttcgcgggcggctacgtcggaacggaaaaggagcgcgccgcgggcgttccgcagctgggccatgaccttgtcggcctgcgcaccggcatccagaaaacgctttcggacgcgctggcgctgttcggcagcctcgcttacgaagaccgcaagtacggcggcgccgatccgctcttcctcgtcacccgccatgacaagcagtggaacctgaacatgggcctgaactgggtgcccgccaaactgtggcgcgtcacgccccagctggccctgacctcggtgaaatccaacgtcgcgatttccgactacaagcgcagcctgttctcggtcacggtgcgccgcgacttctga

SEQ ID NO: 554 - protein, 444 aa, Polaromonas sp. CF318
MYSKNKLFSGGVTVLLAILANGLAHAEVDALVSNARSLLDQSQAQKAFDLLEPQEAARAGDPDFDTVLGIAANETGQYTRAVFALERVLAVQPSNSRARAELGRALFSVGDTKASRQVLLETKQDNIPAEAAATIDQFLQAIDRTEEAARSSVKPFLEASIGYDTNINSGPGNPNVAVPAFGGLIFTLNPAGVETKDAFMSLGGGLSARYVVDPRWSLIGNVYGNARVNSKYNDFNTGQVDVNFGASYRYDKHEFSGVVQAGTYTVAGSRARDQQGLVGEWTYRIDGFRQWSTYIQWGDLSYPGQSLRDATRTVVGTSYAHAFRDSNIVVFAGGYVGTEKERAAGVPQLGHDLVGLRTGIQKTLSDALALFGSLAYEDRKYGGADPLFLVTRHDKQWNLNMGLNWVPAKLWRVTPQLALTSVKSNVAISDYKRSLFSVTVRRDF

SEQ ID NO: 555 - DNA, 1434 bp, Providencia rustigianii DSM 4541
atgaaaaaagaaaagagaagtgagatgaaaaaaataatcaacaagattgaggtattaattctattattgttttctgcaaattcattttctgaacaaaattatgggcatcaacaatatgaacagataattgaagttttaaatgaaataaataacacaagaaataaatcaccaattataatccctcttaaaattaataaaactgtcgacgaccttggttttattctttatgatttagtcaatcggcagcaattccaaaaaattgatgaattattacctgtctatctgaatgataaaaatcacgataaaggtatggtggattatatttcagcagaaagagcttattttaatggtgattacccattgtcactgaagttttatttaaaaatagtcactgaaaacccgagttcagtgttctctgaaatgaagctagctcatatctatataaaaaatagctatcatcgtgaagcattaggtttatataaaaagataaaaaataaatatcgagtaaatttacctgaagaccgaataaaacagatagataatgaaattacagcattagaaaatcgcgctcattggcaagggaatttcaatactgacttaaagtatgacactaactatacggaggctcacggtaatgatgaacagcaatgtggtgctatctggtgcatgcaaggtagtaaaatcaaatccggtttggtgtatggcttctctggaaatgccaataaaatcctttggcagaatcgagggcattcactgttagccagtgtcggtggaaatgtatgggaatatcctcatcgctcagtaaaacggcgtttttcaagttattcatcagtaagctatcagtatctttacgggaataaaaagatcacgttttcacctattgtagatattaattggcgagggcatttatttgaccattacagtgtaggtgcgagcattactagcgcatattctcccagcagtaaactttatttactgtctaacataatgtataaaaaccaattttttttcggaaaacgagaatcgcgttcaggttatgatattaattacagtataacggcaatttattcggttaatccgcaatggagtttattctcaaatttatatggtggtaaaaatattgagcaatataaaagtgacagctatcaagtatcagggttaaccgtggggtcaattaatgtatttggcacgaacaagttagtcaataaattaataagcagcaatcataattttttcgatttcgacagttcacttaatacaaagcgacacgatgagtcatgggctttaaatagccaaataacgctattaggtcacacatttttatcattaacaccaacgctatatattaattataaattcaacgatagtagtgcaaaaataagctattcctataataaaagcgaagtgggcattaattttagtaaaacgttttaa

SEQ ID NO: 556 - protein, 477 aa, Providencia rustigianii DSM 4541
MKKEKRSEMKKIINKIEVLILLLFSANSFSEQNYGHQQYEQIIEVLNEINNTRNKSPIIIPLKINKTVDDLGFILYDLVNRQQFQKIDELLPVYLNDKNHDKGMVDYISAERAYFNGDYPLSLKFYLKIVTENPSSVFSEMKLAHIYIKNSYHREALGLYKKIKNKYRVNLPEDRIKQIDNEITALENRAHWQGNFNTDLKYDTNYTEAHGNDEQQCGAIWCMQGSKIKSGLVYGFSGNANKILWQNRGHSLLASVGGNVWEYPHRSVKRRFSSYSSVSYQYLYGNKKITFSPIVDINWRGHLFDHYSVGASITSAYSPSSKLYLLSNIMYKNQFFFGKRESRSGYDINYSITAIYSVNPQWSLFSNLYGGKNIEQYKSDSYQVSGLTVGSINVFGTNKLVNKLISSNHNFFDFDSSLNTKRHDESWALNSQITLLGHTFLSLTPTLYINYKFNDSSAKISYSYNKSEVGINFSKTF

SEQ ID NO: 557 - DNA, 1500 bp, Pseudomonas sp. CBZ-4
atgccccagccctactgcaagcgatccctcacgtttcacgttttgcccctttccctgctgctgttcatggccccgacggtgttcgccgccgaccaggacaccagcctgcgcctcaaccagagcatcgagtaccgcgccaacaagcaagagcgcgaattgctcaaggacgaattgcccagtgacggcgccgcgccggcgctgaccatcgacggccagacctacagcgtcggcaacaacctcgacgagctgggccgcgcggtgtacctgagtgtccagcgccagcaatggccgaacgcccgcgactacctcaagcgctacaccgccctgcccggccacgacccgatgctcaccgcctacgccaacggcggcctggcccgtgccgatggcgatctggacagcgccgaacggtattaccaggacctgctggcgatccagcccgacttcctgcccgggcgcctggaactggcgcgggtgcagttcgagaaccgcaaagaccgcgattcgaaacacgtcttcgcacagatcagcagcagcctcagcccgtcggacgcccaggccatgggcctgggcaagaccgtcgacagctttatccaggccctcgaccaccgcgaagactggcaaggctcgttcgccatcggcccgacctggagcgacaacctcaaccagtcatccgaaggcagcgtgacttatcgctaccagaccgctgaagaaacctacgtggtcaagcaatccctgcccaaggccgtgtcggcccacggccaggattacgaggccacgctcaacaaacgcatcgccatcagcggccatcacgggctgttcgtgcgctcgcttttgtacggccaagcgtacgaaaaagagagcaagtacaacgaagccaccgtgatcaacaacgccggctacagctaccacgatgcgcgcaaccagtacgccttcgggccgtcgtacgagttcaacaccattggcgacaacgccatgtacagcgcctggggcctgcgcggtgagtggattcacacgctgtcggccacgcgcatgttcaagctcgaaggcgagtacaaggacatgacgtacaaacaccagatcaacagcaacctcgacggcggtatcagctcggtctacgccaccctgtggcaggcattgccccggcagtggacgctgttcggcggcgtcgacatcaccgaacgcaacgcccgcgaccgcgtcgcggcgtacctgcaaaaaggggtgcgcctgggcgtcgccaaggatttcgacatcggcgtgagcgccgtgctgttcgcctcgtaccgcaagcgtcaatacgatgcctacagcgcaatcgtcgatggccgacgcaatgaagatgagcaaggctacaccttcatcctgcgtgccccacggctggcggtgtacgacgtggtgcccagtcttacggtcaaatacaacaaggtgcagagcaacatcgactggatttattcctacgacaaaaacagcatcagcctaaaactggagaaacagttctag

SEQ ID NO: 558 - protein, 477 aa, Pseudomonas sp. CBZ-4
MAPTVFAADQDTSLRLNQSIEYRANKQERELLKDELPSDGAAPALTIDGQTYSVGNNLDELGRAVYLSVQRQQWPNARDYLKRYTALPGHDPMLTAYANGGLARADGDLDSAERYYQDLLAIQPDFLPGRLELARVQFENRKDRDSKHVFAQISSSLSPSDAQAMGLGKTVDSFIQALDHREDWQGSFAIGPTWSDNLNQSSEGSVTYRYQTAEETYVVKQSLPKAVSAHGQDYEATLNKRIAISGHHGLFVRSLLYGQAYEKESKYNEATVINNAGYSYHDARNQYAFGPSYEFNTIGDNAMYSAWGLRGEWIHTLSATRMFKLEGEYKDMTYKHQINSNLDGGISSVYATLWQALPRQWTLFGGVDITERNARDRVAAYLQKGVRLGVAKDFDIGVSAVLFASYRKRQYDAYSAIVDGRRNEDEQGYTFILRAPRLAVYDVVPSLTVKYNKVQSNIDWIYSYDKNSISLKLEKQF

SEQ ID NO: 559 - DNA, 1488 bp, Pseudomonas sp. CBZ-4
atgcccctgtgcctgcccctgcggcttgctttaaccctattcctgagttcattggcctgcaccgcctgggccgatgaagacgacacccggcaactgctgaacaagatcgaccgcaccatggccgagcgcgagcgcgcccatctggtggataccgacccggccaaggacaacgcctcgctgatcaccattgagggccgtacctacaacgtacagaacaccctggaagacctcggccctgcgatctacgtcacgctgaatttgcagcagtggtccaaggtgcgccagttcgtcgagcgctaccgccagttgcccggccatgagccggcgttggtgtcgatggctgagggcatgctggcccgtcaggacaagcactaccgcgaagcgattgccagcctgcgcagggcggtggcgcaaaatccttcattcgtccgggcgaagctggagctggcgcgagcgctgttcgaagacaatcaatcccgcgaagccaaggcgttgtttgaagaagtggcgcaaagcacggtgcccgagcaggtggtgccggtgctggaggggtatcaaggcgcattgcgcgagcgcgacagttggcatggttcggtgtcgatgggcactggctacaacagcaatatcaaccaggccaacggcatgaccacgcgtactcaggtgtgcagtttttttgagtgcgtcgagaccaaccgcaagatgcccgtgccaatcaaatcctccagcctggtgtatgacgcggtggccgagcggcgttttcagatcgagggcaaccaccacctgctggtgcgcgggttgagttacggcaattactaccatcggcacaaggaagacgagccgcagacctattacgacgacaacaccagtgtgatctacgttggctacaactacttgagtgcgctggatgatgtgtcggtctcaccgctgttcgagagttactggggtgatcgacataacaagtatcaggcgacggggctgcgtaccgagtggaaacacacactgaccgagcgcttgcaacttaccgcccaggcgcaacagaagcattttcgcttccagggtgaagagcgcgattacttcgagaattacgacgagcgcatggtgggcggttctgcttcctacctgctgggtagccagaccctggtgtacggcggcctgacctacacgcgccgcacccagccgcaggaatcggcccgcaacaaggagtacatggccagcctgggtctgtatcggatgtttgatgtggggatcaatctgaatgccaccgcgctgtaccggcgtacgtgttatgacgaggcggacgcttttctcggcggcctgcgcgaagatcgccagcagatctatatcgccaacctggccgtaccgcgattcaagttcgccggcctggtgcccagcctttacgtgaagcgtacggtcaacgcgagcagcatcgactgggcatacacctaccgccagaccgaagtggcactcaaagtcgaaaagagcttttag

SEQ ID NO: 560 - protein, 495 aa, Pseudomonas sp. CBZ-4
MPLCLPLRLALTLFLSSLACTAWADEDDTRQLLNKIDRTMAERERAHLVDTDPAKDNASLITIEGRTYNVQNTLEDLGPAIYVTLNLQQWSKVRQFVERYRQLPGHEPALVSMAEGMLARQDKHYREAIASLRRAVAQNPSFVRAKLELARALFEDNQSREAKALFEEVAQSTVPEQVVPVLEGYQGALRERDSWHGSVSMGTGYNSNINQANGMTTRTQVCSFFECVETNRKMPVPIKSSSLVYDAVAERRFQIEGNHHLLVRGLSYGNYYHRHKEDEPQTYYDDNTSVIYVGYNYLSALDDVSVSPLFESYWGDRHNKYQATGLRTEWKHTLTERLQLTAQAQQKHFRFQGEERDYFENYDERMVGGSASYLLGSQTLVYGGLTYTRRTQPQESARNKEYMASLGLYRMFDVGINLNATALYRRTCYDEADAFLGGLREDRQQIYIANLAVPRFKFAGLVPSLYVKRTVNASSIDWAYTYRQTEVALKVEKSF

SEQ ID NO: 561 - DNA, 1434 bp, Pseudomonas sp. FH4
atggcccctgcggtatttgctgccgaccaggacaccagcctgcgcctgaaccagaccatcgagtaccgcgccaaccagcaagagcgcgagttgctcaaggatgaactgcccagcgacggcgccgcgccactgttgaacatcgatggccaggactacaccgtcggcaacaacctggatgagttgggccgtgcggtgtacgtgtccctctcgcgccagaactggccacaggccagggactatctcaaacgctacaccgccctgcccggccacgacccgatgctcaccgcctatgccaagggcggcctggcccgcgccgatggcgatctggaacaggccgaagattattaccggcagttgctggcgatacagtccgacttcctgccgggccgcctggagctggcgcgggtgctgttcgagaaccgcaaggatggcgagtccaacgccgtattccagcagatcagcagcggcctcagccccgccgacgcgcaggccatgggcctgggcaagaccgtcgacagtttcaagcaggccctggatcaccgtgaagactggcaaggctccttcgccatcggcccgacctggggcaaaaacctcaatcagtcacccgaaagcacggtgacgtatcgctacgtcactgccgaagaaaccattctggtccaacgctcgctgcccaaggccgtgtctgcccacggcgcggattacgaggccacgctcaacaaacgcatcgccctcagcggccatcacggggtattcatgcgctcgctgttgtacggccaggcgtatgaaaaagagagcaagtacaacgaaggcacagtgatcaacaatgccggctacagctaccacgatgccaagaaccagtactccttcgggccgtcgtatgagttcaacaccattgccgacaacgccatgtacagcgcctgggggctgcggggcgaatggatccacacgttatcggccacgcgcatgttcaagctcgaaggcgaatacaaggacatggcctacaagcacgacctcaataccaacctcgacggcggcatcagttcggtctacgccaccctatggcaggcactgccccagcgctggacgctgttcggcggcgtggacctgagccagcgcaacgcccaggaccgtacccaggcttacctgcaaaaaggtgtgcggctgggcgtcgccaaggatttcgaggtgggtgtcagcgccgtgctgttcgcgtcataccgcaagcgccaatacgatgcctacagcgcgattgttgatgaccgtcgcagcgacgatgaacaaggctacacgtttatcctgcgcgccccacgcctggcggtgatggatgtggtgcccagtctgacagtcaagtacaacaaggtcgtaagcaatgtcgactggctttattcctacgacaaaaacagcatcagcctaaagctggaaaagcagttttaa

SEQ ID NO: 562 - protein, 477 aa, Pseudomonas sp. FH4
MAPAVFAADQDTSLRLNQTIEYRANQQERELLKDELPSDGAAPLLNIDGQDYTVGNNLDELGRAVYVSLSRQNWPQARDYLKRYTALPGHDPMLTAYAKGGLARADGDLEQAEDYYRQLLAIQSDFLPGRLELARVLFENRKDGESNAVFQQISSGLSPADAQAMGLGKTVDSFKQALDHREDWQGSFAIGPTWGKNLNQSPESTVTYRYVTAEETILVQRSLPKAVSAHGADYEATLNKRIALSGHHGVFMRSLLYGQAYEKESKYNEGTVINNAGYSYHDAKNQYSFGPSYEFNTIADNAMYSAWGLRGEWIHTLSATRMFKLEGEYKDMAYKHDLNTNLDGGISSVYATLWQALPQRWTLFGGVDLSQRNAQDRTQAYLQKGVRLGVAKDFEVGVSAVLFASYRKRQYDAYSAIVDDRRSDDEQGYTFILRAPRLAVMDVVPSLTVKYNKVVSNVDWLYSYDKNSISLKLEKQF

SEQ ID NO: 563 - DNA, 1500 bp, Psychrobacter sp. 1501(2011)
atgattcattctcaatataaaaaaatatatggttttatgctgctaatattaagttcaatatcaacagtgagcttcgcaaatgaagtgcctacggattctattgcaccacaagatcattcactcgaatcttatcaaaatattgataaagtaattgaaccaatcgaaaatataaaattagcgactaatctaccttctgaaagtaaaagccctaaattgtctaaggaagaaagtaaagattatcttaagcaaaaccctgaagagttcgaagaacttctaagtttactattggttcaagggaatgcagaaactcttaaagaacttttgcctatatatcagcaggtacctaattacgatccgtctgtaattgactggggcaacgctattatagctacccaaaatggagattttgataaagcagttgctctatatcgaacccttaattctcaacttccaaatgttgctatattaagatttcaaatggcaatggcgctattttataaccaacagtttgaagcggctaaattggaatttgaaaagctgcgtagtggtacagaatctgaagaagacatagcggttataaataaatatttagaagctattaatgatcaggacagctgggatgtatatgcctctgtatcctatttagatgattcaaatataaccaattcacctgaacaaggtactcagcttgataacggcaatagtcaagtgacttattcctccccacgtcaagagggcaagggactaaactattatttgagtgctgataaaaaatggagaaaggacaataagcttttcactgtgcttcatttaaatagctttggtaaatattattgggataacaaaaattttaatgatgttactgccggtattgggactggttttggctatcaaaatgcagcgacagaagttgaaattggtcctttttacaacaagcgttggtatggtcaaggcaacaaaggagatggtgatttacatccctatgcagaaactatcggcctgatgacccatataaatcaatggattaatcctaagtttcgataccaaggtgttttaagatatggaaagaccagttatatagagcaatatgatcataatgatggtaaagatctatacttatcgaataccggtatttactttccaaatggtcaacagttttggatatttggtttagattattcaaataaaaactctgaagacgattctgcaacttttgatcgtaccggtttaaggttaggttggggtcaaacatggccaaaggggtactctactaaatttaatatagggtatgcgcaacgagattataaagctgaagatttcttcggtattaaacgtgaaaatgaagagtacagtacaggactatctttttggaaacgtgattttaccgtattcggtttaaccccccgtcttgagttagattattacaaagttgaaagtaactctccattcgaagaatacgataaaaccaatgtatcagttgaactcactaagtctttttga

SEQ ID NO: 564 - protein, 499 aa, Psychrobacter sp. 1501(2011)
MIHSQYKKIYGFMLLILSSISTVSFANEVPTDSIAPQDHSLESYQNIDKVIEPIENIKLATNLPSESKSPKLSKEESKDYLKQNPEEFEELLSLLLVQGNAETLKELLPIYQQVPNYDPSVIDWGNAIIATQNGDFDKAVALYRTLNSQLPNVAILRFQMAMALFYNQQFEAAKLEFEKLRSGTESEEDIAVINKYLEAINDQDSWDVYASVSYLDDSNITNSPEQGTQLDNGNSQVTYSSPRQEGKGLNYYLSADKKWRKDNKLFTVLHLNSFGKYYWDNKNFNDVTAGIGTGFGYQNAATEVEIGPFYNKRWYGQGNKGDGDLHPYAETIGLMTHINQWINPKFRYQGVLRYGKTSYIEQYDHNDGKDLYLSNTGIYFPNGQQFWIFGLDYSNKNSEDDSATFDRTGLRLGWGQTWPKGYSTKFNIGYAQRDYKAEDFFGIKRENEEYSTGLSFWKRDFTVFGLTPRLELDYYKVESNSPFEEYDKTNVSVELTKSF

SEQ ID NO: 565 - DNA, 1475 bp, Psychrobacter sp. JCM 18903
atggcagcaccagaattaccagaaataaaacccgatcttgatcaagctgcggagttgcttagacgcgaaaatcagacttctgtgtcagatcctactgcaccctctaccgctatatcagattctgaagcacaagatgctattagaagtcgtcagcaacttgccaagcaacggcttataatctagaagcgctaaaagccaatccagcagcgtttagcaagtatttaaatgatgcattgtctgcacaagatatggtaacggttaaagagttattgccgcattacaaagcgttaaaaaccaatgatccaatgctgatcaaattcgctgatgcgctcatatatcgcagtgaagccaaaaacaaacaagccattgccatttatcgtgacatgcttgcaactgatccagactttcatccggtacgtttgaatatggccattgccatgcaagcagacaagcagtatgtggcggcaaaggagcagtttctaaaattgcaggcagttgagttaccagcacccgtcatggctagggtgcaaaactcattggcgcagatcaatagttcagaaaaatggcaattcaatgcctctgccagttatgtaagagagaataatattaatgacgcgccatcgtcatctattcaatctgacttagggcgctcgattgagcaaaaatcagccaatggccttcaggtgtctgctagcgcgaataaacgctttaacttaccgaataatttctatgctacagtgggtggtaatgcatccctaaaaggatattgggatgagcctgactataacgattatctattcactgcctctacgggagtcggctacgatgatgccaaaaacgacgtttctttgaccccatttatcaccaagcgttattatgatgaagcgccctatagtttgcgtaaaggcgcaactgtcagcggctcacgctgggttaagcccaagctaaaactgtcagcgactggtattttgtccaaagaaacttttgaagatgatagcaatgcaaatcgcgaaacagatggcagattccttggtttaaatgctttttatattaaggatgccaaagaatacttttatgggggtgtaggtaattatcgaaacgatgtacccaaatcgagtattattagctatgatcgtaattctgtaaatgctggttggggtcgtgaatggaggcgtggactctccacattagcaacagtaggttatggtatcaaggactatgacgatcctgcagatgcttatccagcaggaagtggagcatggaaaggctattataatgcggtaggcggcgtgccgggctcaaccagagaagacaaatccacttcattaggtttgcaagtctggaaacgtgactttaccttgtatggtttgacaccgcgtttggtctttgattatgaaacaacttcaagtaactttgcttactatgatgatcgggatgaaaagtctgcaacggtgttattaacaaagaccttttga

SEQ ID NO: 566 - protein, 491 aa, Psychrobacter sp. JCM 18903
MAAPELPEIKPDLDQAAELLRRENQTSVSDPTAPSTAISDSEAQDAIRSRQQLAKQRLYNLEALKANPAAFSKYLNDALSAQDMVTVKELLPHYKALKTNDPMLIKFADALIYRSEAKNKQAIAIYRDMLATDPDFHPVRLNMAIAMQADKQYVAAKEQFLKLQAVELPAPVMARVQNSLAQINSSEKWQFNASASYVRENNINDAPSSSIQSDLGRSIEQKSANGLQVSASANKRFNLPNNFYATVGGNASLKGYWDEPDYNDYLFTASTGVGYDDAKNDVSLTPFITKRYYDEAPYSLRKGATVSGSRWVKPKLKLSATGILSKETFEDDSNANRETDGRFLGLNAFYIKDAKEYFYGGVGNYRNDVPKSSIISYDRNSVNAGWGREWRRGLSTLATVGYGIKDYDDPADAYPAGSGAWKGYYNAVGGVPGSTREDKSTSLGLQVWKRDFTLYGLTPRLVFDYETTSSNFAYYDDRDEKSATVLLTKTF

SEQ ID NO: 567 - DNA, 1554 bp, Psychrobacter sp. PAMC 21119
atgaacaatcgatatatacgtaaacctttaacagcttcaattctgctatctataatggcttttcctctatcggttatggcagcagagcccgtattagaagagatagaaccagagcttgaccaagctgccgaactcctcaagcgtgagaaccaaaccgctgtatcagatcctacagcaccttctaccgttgtctcggatacagaggctcaacgtgctatcagaagtcgtcagcaacttgctgccgccaccgcttacaatttagaagccttaaaagccaatccagcagcatttagcaagtatttaaacgatgcgttggctgcacaggatatggtaaccgtcaaagaattattgccgcattataaagcactagaaaccaatgacccgatgcttattaattttgctgatgcactcgtatatcgtagtgaagctaaaaacaagcaagccatcgccatctatcgtaatatgctagcggcagacccagacttccacccagtacgcctgaatatggcattggctctgcaagcagacaaacagtatgccgccgcgaaagaccaattcttaaagctacaatcagtcgacttaccggcacctgttatggctagggttcaaggctcattggctcagataaacagtctcgaaaactggcgttttgatgcctctgccagctacgtcaaagatgataacatcaatgatgcgccatcaaagactatccaatctcaattaggcaactcagttgagcagaagtcagccaatggtattcaagtatcagccagtgcaaacaaacgctttaatttacccgataatttttatgccacggtgggtggtaatgcctcactaaaaggctattgggatgagactgactataacgactatttattcacggcttctgctggtgtcggttatgatgatgccaaaaatgatatttccctcacgccatttgtgactaaacgatactatgatgaagagccatatagtctacgtaaaggcgtcactgttagtggttctcgctgggtaaaacctaagctgaagctatcagcgactggcattttatctaaagaaacgtttgaagatgacgacaataaaaatcgcgagactgatggacagtttttgggtctaaatgcattctatattaaagatgccaaagaatacttttatggtggtcttggtaattatcaaaacgacgtacccaaatctagcattatcagctatgaccgcaactctgtaaacgttggttggggtcgtgagtggaagcgaggtatttctaccctaacgacagtaggctacgctgtaaaagagtatgatgatccagcggatgcttacccagcaggtagtggtgctttaaatggttactacaatgctgtcggtggtaaagttggctcgacaagagaagacaagaccacctcattaggcttacaagtctggaagcgtgacttgactctatatggtctgacaccgcgactggtatttgattatgaccaaacctcaagtaactttgattattatgatgatcgcgatgagaagtcggcaaccatattgttaaccaagaccttttaa

SEQ ID NO: 568 - protein, 517 aa, Psychrobacter sp. PAMC 21119
MNNRYIRKPLTASILLSIMAFPLSVMAAEPVLEEIEPELDQAAELLKRENQTAVSDPTAPSTVVSDTEAQRAIRSRQQLAAATAYNLEALKANPAAFSKYLNDALAAQDMVTVKELLPHYKALETNDPMLINFADALVYRSEAKNKQAIAIYRNMLAADPDFHPVRLNMALALQADKQYAAAKDQFLKLQSVDLPAPVMARVQGSLAQINSLENWRFDASASYVKDDNINDAPSKTIQSQLGNSVEQKSANGIQVSASANKRFNLPDNFYATVGGNASLKGYWDETDYNDYLFTASAGVGYDDAKNDISLTPFVTKRYYDEEPYSLRKGVTVSGSRWVKPKLKLSATGILSKETFEDDDNKNRETDGQFLGLNAFYIKDAKEYFYGGLGNYQNDVPKSSIISYDRNSVNVGWGREWKRGISTLTTVGYAVKEYDDPADAYPAGSGALNGYYNAVGGKVGSTREDKTTSLGLQVWKRDLTLYGLTPRLVFDYDQTSSNFDYYDDRDEKSATILLTKTF

SEQ ID NO: 569 - DNA, 1440 bp, Psychrobacter sp. PRwf-1
atgtatttcaaacggcttttttgtcatatcggtatctctatgaataaaaaatatcaggctatcgtctattttgcagtagcaacggtggcgcacgctcaggaagtgcctttatcacaaacgattttttttgatgaagagcctcagataaagccagaattactgcttgatcattcaaaaaaagattcaattcaagttgttttacctccaaaaaatcaagacttagaatcacaagtgaattttgcgattatcagcaagaactgggataagctgacaactttactagatgaatataaagacacaccaagtatggatcctattctatacaattatggattaggagctctttacaggcataatggtcgccaagctgaggctattaagctgtatgaaagcataatacaacaacaaccaaacttgtattatcctcgttttgatctagcaatgatgttatatgaaaataagcagttcaatgaggctcaaaatcatttagaggttgttgaaccccatttatcacctcagatgcagataattgtaagtaaacttttacaagatataaaaaaatcacagcagtggaattacgatgttaactttagttatgaaaaaacggataacgtcaatcaagcctctgatttaaaggaaattgttcttggtgatgcggtgttcgttagaagtgaagactccctcccacaagaggcccacggtattcgctatggtttaaatagtagtatggataaaaatatatttggtaaccattatttagtagctgatgcagaactatcaggtattcattattgggacaattcagattatagtgagattactccaaatgcgagcttaggttatcgctttaaagatattaaacagatgttaggagttacagcacttgttgataagaactttttgggtggagaagattacagtacaaattacggtggtgtgctgtcgtataatcggaagttatctaatcaacttcaagtgtcaggaaactattcacatatccaaaagaactatactgaagatgatttagctaaaaactacgatggacatctcaatgcagcttctttgcttctcttttaccaacccaaattaaaatggctagtttatgtgggggcagatgcaatctatgacaggcttgaggataagtctgaatcttcagataagaaaggtttcagagcaggtactgtattttcaggagagaaatttattgtaagaacaaaccttcgctactctgaaagggactttttagataataactatttgtataatacgaaaagaaaggatgatgagtatcaattaagcacatcaataggccataaagacttagtttggaagggattttctcccaaaattaattatgaatttaaaaagatagatagtaacttacctctttatgaaagaaatgatagtacggtgttcattgaatttaataaaagcttttaa

SEQ ID NO: 570 - protein, 479 aa, Psychrobacter sp. PRwf-1
MYFKRLFCHIGISMNKKYQAIVYFAVATVAHAQEVPLSQTIFFDEEPQIKPELLLDHSKKDSIQVVLPPKNQDLESQVNFAIISKNWDKLTTLLDEYKDTPSMDPILYNYGLGALYRHNGRQAEAIKLYESIIQQQPNLYYPRFDLAMMLYENKQFNEAQNHLEVVEPHLSPQMQIIVSKLLQDIKKSQQWNYDVNFSYEKTDNVNQASDLKEIVLGDAVFVRSEDSLPQEAHGIRYGLNSSMDKNIFGNHYLVADAELSGIHYWDNSDYSEITPNASLGYRFKDIKQMLGVTALVDKNFLGGEDYSTNYGGVLSYNRKLSNQLQVSGNYSHIQKNYTEDDLAKNYDGHLNAASLLLFYQPKLKWLVYVGADAIYDRLEDKSESSDKKGFRAGTVFSGEKFIVRTNLRYSERDFLDNNYLYNTKRKDDEYQLSTSIGHKDLVWKGFSPKINYEFKKIDSNLPLYERNDSTVFIEFNKSF

SEQ ID NO: 571 - DNA, 1554 bp, Psychrobacter sp. PRwf-1
ctagaaagtcttagtaaataaaatggtggctgttttgtcatcacggtcatcatagtatttgaagttacttgaggtcttctcataatcaaataccaagcgtggggttaagcctagtaccgtcaaatcacgcttccaaacttgcaaccctaaggagctggttttgtctttgcgatgggtatcattaccctctacgcgataagttcggtaaaagaaatctgcgatatcatctgaaggcttatcatagtctttaatagcatagcttgctgaggctaaagtagagataccttggttccattcacgcccccagcccacgtttactgaatttctatcataacttaagaagctggtcttatcgacatcatttttatagctacccaaaccaccataaaaatactcgttggcatctttaatatatagaccattgacccctaaaaacaggccatctgcttcacgcagatctttgtcatcatcatctatggtttcattagagtacatgcctgttgccgtcagcttgagctttggctgcacccaacgtgagccactaagcgtcaccccctttcgccagctatacggctcttccccataaaagcgcttggtcacaaaaggactaatagacacatcatttttggcatcatcataacccaaggctgtcgaggctgtgaccagataatcattatactcactattatcccaatagcctcttagcgaggcattaccacccacttcagcataaaagtttttgtctaggttaatacgtttactcgcacttcctgatacctgcaaacctttgccggattcaggcttacttgtggcacctaattgagcatctacaatttgcctttcaggtaccccatttaagttcttatcatacacatagctggcagaagcactaaagcgccactgctcctgctctttgatgcgctcaattaagcgatcaacattggccattaccggtggtggaatatccgcgccacgcagcttctgcaactggtctgcagcagcggtatactgcttatcagcatacaacgcttgggccatattaagacgcactggatgaaagtcagggttgtctgccaacatgtctttatatattgcaatagcttttttgttttgtccttcactacgatataccaaggcatcagcgaacttaattagcatgggatcattaacttctaatgccctataatatgggagcagctctttaacagtggccatatcctgcgctgccaatgcggcatttaaaaactttgtaaaagttacagggtccgcttttaaagcctctaaatcatagccttgtatagattgaacttttttgcgctcatctagtgctttttgtgcttcttgcttagatacggttgctgttggtacgttcgtgcctaaggtaatatcttggcgctcacgtttaattaattcatctgcctggtcattattatctctagtctcctcgataaatccaggaggaatatcgtcagccgcatagaccagaggactataaactgcgctgagcaataaggtagaagtggtgagggttcttaagaggtgcgaatgtgtcat

SEQ ID NO: 572 - protein, 517 aa, Psychrobacter sp. PRwf-1
MTHSHLLRTLTTSTLLLSAVYSPLVYAADDIPPGFIEETRDNNDQADELIKRERQDITLGTNVPTATVSKQEAQKALDERKKVQSIQGYDLEALKADPVTFTKFLNAALAAQDMATVKELLPYYRALEVNDPMLIKFADALVYRSEGQNKKAIAIYKDMLADNPDFHPVRLNMAQALYADKQYTAAADQLQKLRGADIPPPVMANVDRLIERIKEQEQWRFSASASYVYDKNLNGVPERQIVDAQLGATSKPESGKGLQVSGSASKRINLDKNFYAEVGGNASLRGYWDNSEYNDYLVTASTALGYDDAKNDVSISPFVTKRFYGEEPYSWRKGVTLSGSRWVQPKLKLTATGMYSNETIDDDDKDLREADGLFLGVNGLYIKDANEYFYGGLGSYKNDVDKTSFLSYDRNSVNVGWGREWNQGISTLASASYAIKDYDKPSDDIADFFYRTYRVEGNDTHRKDKTSSLGLQVWKRDLTVLGLTPRLVFDYEKTSSNFKYYDDRDDKTATILFTKTF

SEQ ID NO: 573 - DNA, 1158 bp, Rhodobacteraceae bacterium PD-2
atggggacccaagcggtgcgcgaagccgagttgcgccgtctctgggcgctgtccatggcgcatgtccggcagggccgtccccgcgcagcgcagccctttctcgaccggctggtctctcttgcgcccgatgccgtcacctaccgtctggaacttgccaacgcgctggaggctgcgggccagcccgagcgcgcgcgttaccactatgccctcgcgcgcggtgccgcgctgccgccgccgcttgccaccgaggtgacgcggcgcattgaccggattgatcgggcccgggtctgggaaggcaacttccgcttcgcgatcgtgcccgagagcaacccggcgaaacgaaccgcctctgacaccatcgtgatcggcgacctgcccttcaagctgaaggatagctcacgcgcgcagccggcacggggcatcgagcttggcctcggacttgccgccctgcccaggctgggaccggatctcaggctgcgactgggggcagccgtcgatgcgcggctctacgaagagggggcgcccgacgacgttcaaacgcgggcagagctggggctgctgcacttcggcgaccgcaaccgcaggctgggcgccgggcttacccttggcaagcgctggatcgacggcgagccctacgccaacacgcgcggcgtctacctgacctggggccggtccatcgacgcccgggcgcgcagcgctctcaacctgactctgatccgcgagcgcaccgactatgaagcacccggctccgagtccgcgacccggtccattgccgccgcatcgctcagccatacggtcacgccccggctgcaactcagcttcggtttgcaactggagcgaaccgaaagcgcgcttgcaaccgaagcggggcaaggcggagcggtgacgctgggcgcgcgctacgccttcgaaggagggctgctcgccgagctgacgctggcgcttggccggcatgagcgcgaggggcccgaccgcctgctgggcattgtgcgcgaggatcggcgccagagcctcaccctgaagctgacgcaccgcgactgggcggtcgcaggctttgcgccggtgctcgagctgggcgcagagcggcaggactccaccaacgacctgtacagctacgaaaaccaccgcgcgttgctgggcatcacccggcggttctga

SEQ ID NO: 574 - protein, 441 aa, Rhodobacteraceae bacterium PD-2
MTRLAAQGARRLLAGLFLALALVSQAPAQQPEEALARAEAQVNAGDYDTAISALQGMGTQAVREAELRRLWALSMAHVRQGRPRAAQPFLDRLVSLAPDAVTYRLELANALEAAGQPERARYHYALARGAALPPPLATEVTRRIDRIDRARVWEGNFRFAIVPESNPAKRTASDTIVIGDLPFKLKDSSRAQPARGIELGLGLAALPRLGPDLRLRLGAAVDARLYEEGAPDDVQTRAELGLLHFGDRNRRLGAGLTLGKRWIDGEPYANTRGVYLTWGRSIDARARSALNLTLIRERTDYEAPGSESATRSIAAASLSHTVTPRLQLSFGLQLERTESALATEAGQGGAVTLGARYAFEGGLLAELTLALGRHEREGPDRLLGIVREDRRQSLTLKLTHRDWAVAGFAPVLELGAERQDSTNDLYSYENHRALLGITRRF

SEQ ID NO: 575 - DNA, 1293 bp, S. bongori
atggcaacacttttatttgcgattttttctgctccggttttctcgggacaaaaaggacaaccggaatatatagctcgcaagttcattggctatttaataaataacaacgccgagggcgttaaaaacacgctgcaacaatgcaacaagtgccttcagaatattgatccactttttcttgactgggctaatgctattcttgaatatcagaagaaaaattatgctgggtcaatacgatattacagaaagataatctcatccagacctgactggtacagtgcgaggttacaactggccacagcattatacctaaataaagatattcgttcagcagaggaacaactgaggaaattgcgtagtgaaaacctgtcagaagaggtggctagcctcattgacggatttattgcccgagtacaaaaagcagatcattggtcattccgtggtggtctcacgtatctgaacgaaaagaatattaataatgcgccacccgccaaccgcactatcggaggatggcgatccgaaaaaccgcaatcgggtaaaggcatgatgtactggggggaggcggaaaaaagattttctcttccagataatttttttgttatcacacaactggcggtagcaggaaaaatatactggaataatcattcttatgatgagctggatggcagtattggtacaggcatgggttaccggaacgtgaacactatggcccagctaatcccattttacgaaaaaagttattatggcggaggacggacgtcaaatggtggtctgcagccttactcaaatactgttggtattaaaatggaaacagaattccagctctcaccacgctggcgtttatactcggatctaaagctgggtaaaaataaatataaagaaaagaattatcttgatgggcatcgttactctttgaatgagaccctgatttattttcccagtccacgacagtatatttctgcgggtctgggatacagtatgctcagaacgaaacaaaaagacagttctttcgataagaccgccttccagaccggatggatgtatgaatggaatggggggatatcaacgttcctccaggccgcttatggctatagaacctacctggccggggacttctggggaataaagcaaaccaactatgaatacagtacttctgtcacgatatggcaccgcgatatctatttttggggaataacaccaaaagtaacatggagttatcaacgaattgacagtaatcatcctttctatgatacagaaaggaatcgtctttttctgagtttcagtaaatatttctga

SEQ ID NO: 576 - protein, 430 aa, S. bongori
MATLLFAIFSAPVFSGQKGQPEYIARKFIGYLINNNAEGVKNTLQQCNKCLQNIDPLFLDWANAILEYQKKNYAGSIRYYRKIISSRPDWYSARLQLATALYLNKDIRSAEEQLRKLRSENLSEEVASLIDGFIARVQKADHWSFRGGLTYLNEKNINNAPPANRTIGGWRSEKPQSGKGMMYWGEAEKRFSLPDNFFVITQLAVAGKIYWNNHSYDELDGSIGTGMGYRNVNTMAQLIPFYEKSYYGGGRTSNGGLQPYSNTVGIKMETEFQLSPRWRLYSDLKLGKNKYKEKNYLDGHRYSLNETLIYFPSPRQYISAGLGYSMLRTKQKDSSFDKTAFQTGWMYEWNGGISTFLQAAYGYRTYLAGDFWGIKQTNYEYSTSVTIWHRDIYFWGITPKVTWSYQRIDSNHPFYDTERNRLFLSFSKYF

SEQ ID NO: 577 - DNA, 1509 bp, S. chinhatense
atggacatatcagcctttcgcattttgatctcgtacgagccgctgttgcttgctctggcggccagcttgtgggcgaccgttgccaacacgcagacgacaagcgggcaggacacgcgcctgcggcttgaccagcaggtcgatcgccagcgcgtgaaccaggaatcccgcgcgatcgaggacgctgaagcgctcgacggtgatacatcttcgctgaccgtagacggtcagacttacgcggttggcaacactgtcgatgacatcggacaagctctctatatctcagtgacgcgcaaacagtggcccgacgttcgccgtttcctcgccgcctatcagaagctggatgggcatgatcccatgctggtcgaatatgctcttggtgcgctcgcgcgcgagaaaggcgacctagctaccgcggaacggcattatcgggcgctgttggcgataaaggcggattttgtccccggtaggctggaactcgcacgcgtccttttcgacaatcacaaggatcgtgaagctgacagcgccttccgggcagcgcgcgatatgctggccgatgatgggtcacaggcgcagggtgtgatcggcacggtcgatgcctatctgggggcgctcaagcgccgcaggagctggcagggaagccttgctgtcgggcccggatacagcagcaatctcaatcagtcgtcggcgagctacacctgcctgctggcgaccgacgacggcacctgccttgtcgaccgacaggttccgcccgcgatcgcggccgctggcgtcaacttcgaagccacgctcgcgaaagatgttccgttgagcggacatggcggcctccgggcgcgggcgatcctgttcggcgatgtctatccggaacatcatgcctattcccaggcgacggcgatcatgcgtctaggctatcaatatcaggccgcccgcaacgccgtctccctctcgccctcattcgagatcggttcgctcggatcgtcggagctctacagtgcgccaggtctgaacgcggaatggacgcacacggtctcgccgcggtcgctcttcaaggttgagggaaattaccgggatttccgttaccgcgatgcggcttttgctccgcaaaatgggccgctcacggatgttgctatcacaggatggtattcgctgacgccgactttgaccgtgttcggtggacccgatgtcattgtgaaggacacgccaagccttgtcgaagcctatcgccaatggggtggtcggctagggatcaacaaggctttcggcaatgtcgcgagcctcttcctcatgggatcatatcgctaccgccgccaccgcgcttacagcgaattgttcgaggcgcagcgcaaggatcgccaattcaacgttatcgggatcgcccgtctacccatcctgaaagtcgggccgctcgttcccgaaatcgttgtccagcacacccgcgtcgagagcaacatcgactggctttattcctacaagcgcacgaccgcgagcgtgaggctcagctatgccttctga

SEQ ID NO: 578 - protein, 502 aa, S. chinhatense
MDISAFRILISYEPLLLALAASLWATVANTQTTSGQDTRLRLDQQVDRQRVNQESRAIEDAEALDGDTSSLTVDGQTYAVGNTVDDIGQALYISVTRKQWPDVRRFLAAYQKLDGHDPMLVEYALGALAREKGDLATAERHYRALLAIKADFVPGRLELARVLFDNHKDREADSAFRAARDMLADDGSQAQGVIGTVDAYLGALKRRRSWQGSLAVGPGYSSNLNQSSASYTCLLATDDGTCLVDRQVPPAIAAAGVNFEATLAKDVPLSGHGGLRARAILFGDVYPEHHAYSQATAIMRLGYQYQAARNAVSLSPSFEIGSLGSSELYSAPGLNAEWTHTVSPRSLFKVEGNYRDFRYRDAAFAPQNGPLTDVAITGWYSLTPTLTVFGGPDVIVKDTPSLVEAYRQWGGRLGINKAFGNVASLFLMGSYRYRRHRAYSELFEAQRKDRQFNVIGIARLPILKVGPLVPEIVVQHTRVESNIDWLYSYKRTTASVRLSYAF

SEQ ID NO: 579 - DNA, 1317 bp, S. echinoides
atggctggcttgacgctggcgctcgcagcgccagcggcggtggcggtggccggtcagaccgcgccgcccacgacccatttgcaggacttatccgcgatcgacgtcttcggcctcgccgaccgcgcgcgcgcagccggccggatcgacgatgccaccggcttctatgacgcgctggcgcatgatcccaacgccgatgtccgcgcggaagcacggtttcgcaaagggatgatgcttgccgatcttcggcgctaccgcgaggcggcgcttgccttccgtgccgtgcttgacgaacaacccaaagccgcgcgtgcgcggctcgagctggcgcgcatgctggccgcgcttggtgacgaacgcgctgcccgccgcgaactccgccaggcgcaagccacgggcctgccgggctcagttgccgcagcggtaggacagttcgatcaaatcctgcgctcccacaagcgcttcggcgggtcgttcgaactggcgctggcacccgactccaacgtcaatcgtgcaacgcaggtgcggacgctcgataccatcatcgcgccgctgacgctctcgaacgacgcccgcgcgcaatctggcgtcgggctacgcctggctggacaagggtatgcccgcctcggtttagcggatggcctcgcactggttccacgcctctccacgctggcaaatctataccgcgcatcccagtttaacgacatttccggaactgcgttgatcggcttcgaatggcagcgtcagaaagaccggttcagcccgtccattggccgaacatggcgctggtatggcggcgcgctctacgcgcacacagatgcggtatcgctcgactggctgcacatcctcggtcgccgtgcgcaattggtcgtcagcgggagcgcaagcaaggcgacgtaccggcgcaatgatctgcaagacggcgcgatcggcgatcttaacgtgtcgattgaacgcgctttgtcagccaaagctggcgcaagcatcggcgtttcgatcacacggcaaaccgcccgtgatccgggatacgccacgaaagcggcaggcgtttcagcgctcggctggcgcgaactcggccagacgaccgtgttcgtttcgggaggattgcggcgaaccgagggcgatgccgccctcttcctgttcggcgaccggcgccgcgaatggttgatgacagcacgcgcaggggcaaccttccggcaacttaaaatcggtgctttctccccttatattcgggtcagctatgagcggaatgcctccagcttgcagctttaccaatacgcacgcaccgccagcgaagtcggcatcactcgcgcgttctga

SEQ ID NO: 580 - protein, 438 aa, S. echinoides
MAGLTLALAAPAAVAVAGQTAPPTTHLQDLSAIDVFGLADRARAAGRIDDATGFYDALAHDPNADVRAEARFRKGMMLADLRRYREAALAFRAVLDEQPKAARARLELARMLAALGDERAARRELRQAQATGLPGSVAAAVGQFDQILRSHKRFGGSFELALAPDSNVNRATQVRTLDTIIAPLTLSNDARAQSGVGLRLAGQGYARLGLADGLALVPRLSTLANLYRASQFNDISGTALIGFEWQRQKDRFSPSIGRTWRWYGGALYAHTDAVSLDWLHILGRRAQLVVSGSASKATYRRNDLQDGAIGDLNVSIERALSAKAGASIGVSITRQTARDPGYATKAAGVSALGWRELGQTTVFVSGGLRRTEGDAALFLFGDRRREWLMTARAGATFRQLKIGAFSPYIRVSYERNASSLQLYQYARTASEVGITRAF

SEQ ID NO: 581 - DNA, 1314 bp, S. elodea
gtgaccgaccgctcgctgatcgccctggcgctggccctgctcgcgcctgcccccgcccttgcccagacgaccgagcagcgccaggtctcggcggtcgagctgttcactctcgccgcccgcgccgagggtgtcgggcgcccggccgacgccgagacgatgtaccgcgcgctcgccaaagaccctgatgccgaggtccgcgccgaggcgcgctttcggctcggccagctgctcgaacggctgggccgcaagcgcgaggcggcgaccacctatcgcgcgctgctcgacgagaaacccgacgccgcgcgcgtccggctcgaactcgcccggctgctcacccagctgggggacgagagcgcggcgcggcgggagctgcgccaggcccaggccggcgggctgccgccgcaggtggcgcagatcgtcgaccagttcgccgccgcgctccgctcgcgcaagccctggggcgccagcctcgaggtcgcgctggtaccggacagcaacgtcaaccgcgcgaccgacgcggcgacgctcgataccgtgcttgcccccctccagctctcgcgcgacgcccgcgagcaatccggcatcggcgcgcgcatcggcggtcagctcttcgcccgcgtgccggtggcgaccaacctcgcgatcgtcccgcgcctatccggccagggcgatttctaccgccagcgccgtttcaacgatacctccgcctcggcactgatcggcctggaatggagcctcgggcgcgatcgcctgcgtccctcggtcggcggcacccagcgctggtatggcggcagcccctatgcgcgcaccgccaccgcggcgatcgactggcagcatccgctcggtaccagggcccagctcaccaccagcgcgaccgtggccgacacgacctatcgcggcaaccccctgcaggacgggctgctgctgaacggcgcgatcgcctatgaacgtgccttctccccccgcgccggcggaagcgtcaccctgtccgccacccgccagacggcgaacgatcccggctatgccaccgccgccggcggcgcgaccctgctcggctggcgcgagttcggccggaccaccgtctatgccaccgccggcttgcgtcggctggagggcgatgcccgcctgttcctgttcgcggaacggcgcaaggactggaacgtcagcctcggtgtcggcgccaccttccgccgcatccagatccgcggcttcgcgccgatcgtgcggctggattgggagcgcaaccgctccaccgtcggcatctatgatttcacccgaaaggcggcgacgatcggcctcacccgggccttctga

SEQ ID NO: 582 - protein, 437 aa, S. elodea
MTDRSLIALALALLAPAPALAQTTEQRQVSAVELFTLAARAEGVGRPADAETMYRALAKDPDAEVRAEARFRLGQLLERLGRKREAATTYRALLDEKPDAARVRLELARLLTQLGDESAARRELRQAQAGGLPPQVAQIVDQFAAALRSRKPWGASLEVALVPDSNVNRATDAATLDTVLAPLQLSRDAREQSGIGARIGGQLFARVPVATNLAIVPRLSGQGDFYRQRRFNDTSASALIGLEWSLGRDRLRPSVGGTQRWYGGSPYARTATAAIDWQHPLGTRAQLTTSATVADTTYRGNPLQDGLLLNGAIAYERAFSPRAGGSVTLSATRQTANDPGYATAAGGATLLGWREFGRTTVYATAGLRRLEGDARLFLFAERRKDWNVSLGVGATFRRIQIRGFAPIVRLDWERNRSTVGIYDFTRKAATIGLTRAF

SEQ ID NO: 583 - DNA, 1242 bp, S. indicum
atgctttcgactgagggggtttcagcgagccagatgcttgatcttggggagcatctcgcggttgcaggcaaaatcggcgatgcgaacctgattctcgatgctctcaagcaaaatgatgaaggctcgcgcgagcaaattctgctcgcaggcatcattgcggtggctcaaggtaatttgtctttggctgaagcgggcttccgaaccctcctattgcgggatcctcacgacaccagagtccggctcgaacttgcacgggtactttttttgctgcaccgatatgcagctgcagattatcattttaggctcagcgctgcgcgaagcccaaagtctgtgcaacataatatttcacttttccgccgcgcaatacaggcacaacgaacatggcgtgtttcggtggaagggggaattgccccggataccaacgtgaactcagcaggtcgtgaccgaattgtcgatttgttcgggttgccctttaacgtggacaacgatgctcgcgaaaaatcaggggtcggtgtttttgcaaatgccgatgttgaacttcggttgcggcgctctgaagcagtgggattgtccatccgcgcattcggaaacgctcgggaataccgtcgttcggcttttaatgatgaggtcgcgggcatcgaaatcggaccacaatttcggtttggcaacgcgcaagtgaccgttgcgggaacaggtctgtttcggtggtatggccgagagatatactcgcgagctctaggagcagcgctacgcgttgaactgcccatctcaacgcaatggcaggtcgatctgaagcctcaattcagatcagtcaattatctccaaaacccaagccaaaacgggccttttatgagcttgaacggtcagattagccgctccctcggaagtcatgccttagggcaaatcgattttctcgcgtcgcgacagtctgctcgcgctcctggctacgcttatcgagaagcagggctaggtgtgagtgcatttgctgaacttggaaatggaattactgtaggaggaagtatcgaggcagcgcggacggtattcgatgctccactcttcggctttgcaaagacacgccgcgactggagagccgcaacaaccatttctgttctcaatcggaactggattttgttaggattctcgcctgtcacgcggctgagttttgcacagtcgaaatctacaattagtttttttgaatatcgtcgaacacgactggaacttgcattgcagcggccattctaa

SEQ ID NO: 584 - protein, 413 aa, S. indicum
MLSTEGVSASQMLDLGEHLAVAGKIGDANLILDALKQNDEGSREQILLAGIIAVAQGNLSLAEAGFRTLLLRDPHDTRVRLELARVLFLLHRYAAADYHFRLSAARSPTSVQHNISLFRRAIQAQRTWRVSVEGGIAPDTNVNSAGRDRIVDLFGLPFNVDNDAREKSGVGVFANADVELRLRRSEAVGLSIRAFGNAREYRRSAFNDEVAGIEIGPQFRFGNAQVIVAGTGLFRWYGREIYSRALGAALRVELPISAQWQVDLKPQFRSVNYLQNPSQNGPFMSLNGQISRSLGSHALGQIDFLASRQSARAPGYAYREAGLGVSAFAELGNGITVGGSIEAARTVFDAPLFGFAKTRRDWRAATTISVLNRNWILLGFSPVARLSFARSKSTISFFEYRRTRLELALQRPF

SEQ ID NO: 585 - DNA, 1242 bp, S. japonicum; identical to SEQ ID NO: 583

SEQ ID NO: 586 - protein, 413 aa, S. japonicum
MLSTEGVSASQMLDLGEHLAVAGKIGDANLILDALKQNDEGSREQILLAGIIAVAQGNLSLAEAGFRTLLLRDPHDTRVRLELARVLFLLHRYAAADYHFRLSAARSPKSVQHNISLFRRAIQAQRTWRVSVEGGIAPDTNVNSAGRDRIVDLFGLPFNVDNDAREKSGVGVFANADVELRLRRSEAVGLSIRAFGNAREYRRSAFNDEVAGIEIGPQFRFGNAQVTVAGTGLFRWYGREIYSRALGAALRVELPISTQWQVDLKPQFRSVNYLQNPSQNGPFMSLNGQISRSLGSHALGQIDFLASRQSARAPGYAYREAGLGVSAFAELGNGITVGGSIEAARTVFDAPLFGFAKTRRDWRAATTISVLNRNWILLGFSPVTRLSFAQSKSTISFFEYRRTRLELALQRPF

SEQ ID NO: 587 - DNA, 1455 bp, S. lithotrophicus
atgctgcaatgtgctgtgatattgggcgggggggatatgagattcgcaagattgccatgttgggcgttgtctgggctggtgctggcggcgggcatggcacatgctcaagacgccatcaatcagaatgaaagaatcaagaccgccgccgcggcgggaactgccgaatcgacgcagcagtcggcagccatcgaacggcagaagttgctgcaggacgcagccaatctgatcaaatccggcaagtcgaaagacgcctacctgttgctggagccggaacaatccatacgcgccggggatccggattacgactatttgctgggtatcgccgccctggacagcggcaaaccgaacgaggcgatatttgcgctggagcgcgtgcttgcggtaagacccaaccacttgcaggcgcgcgccgagatcgcccgggcatatctggccgtcggcgaaaaggcagccgcgaagcaggaattcgaaacggtccagagccagaatccgcccaaagaagtgaatgccaccatccagcggttccttgatgccatcaatcaggggcagggcggtgaagccacgatgctgagcggttatctcgaagcggacgtgggtagcgacagcaacgtcaacagtgcgaccggcagcaaccaggttgcgatccccgcttttggcggtgcggtcgcgacattgaatgcgagcggcattgagaccagggccacctttgcgaatgtcagcggtggcgccaatgtccgtcatgccctggatgccgaatggtcgatattcggcggtgcgaacgtcaaccagcgcctgaactcgaaacagtccgttttcaacacgcgtggcctggacggcaatgtcggcttcaatctgaccaaggcggaagacagctattccgccgccctgcagttgcagagcttcgatgtcgacaacaagcgttaccggaatggcaccggcatgaccctgcagtggcagcatgacctgagccagagaagcagccaggccagcggctatttccagtacaccaacctgaagtatcccgggcagtcggttcgcgatgccaaccgctatgtgcttggtgtggcctatgccagcgtgctgggcggcgaatatacgccagccgtctatttcggcgcctatgcgggcacggaaaaggagaaacaatccggcgtaccctatctcggccataagctcttcggcatgagagtcggcggcgaaatgaatatctatgcgcaggctaaactgttcggctctttgagcgccgaatcgcgcaattacggcggtgatgacccgttgttcctggtcacgcgcaaagacacccaggcagacctgaaagtgggcgtcaactatgagatggccaaactctggacgctcaccccccagatcagctacaccaagaacaaatccaacatcgtcatcaatgactacaagcgcaccatattcagtgtcggtctgcgccgcgacttcaattaa

SEQ ID NO: 588 - protein, 484 aa, S. lithotrophicus
MLQCAVILGGGDMRFARLPCWALSGLVLAAGMAHAQDAINQNERIKTAAAAGTAESTQQSAAIERQKLLQDAANLIKSGKSKDAYLLLEPEQSIRAGDPDYDYLLGIAALDSGKPNEAIFALERVLAVRPNHLQARAEIARAYLAVGEKAAAKQEFETVQSQNPPKEVNATIQRFLDAINQGQGGEATMLSGYLEADVGSDSNVNSATGSNQVAIPAFGGAVATLNASGIETRATFANVSGGANVRHALDAEWSIFGGANVNQRLNSKQSVFNTRGLDGNVGFNLTKAEDSYSAALQLQSFDVDNKRYRNGTGMTLQWQHDLSQRSSQASGYFQYTNLKYPGQSVRDANRYVLGVAYASVLGGEYTPAVYFGAYAGTEKEKQSGVPYLGHKLFGMRVGGEMNIYAQAKLFGSLSAESRNYGGDDPLFLVTRKDTQADLKVGVNYEMAKLWTLTPQISYTKNKSNIVINDYKRTIFSVGLRRDFN

SEQ ID NO: 589 - DNA, 1509 bp, S. lucknowense; identical to SEQ ID NO: 577

SEQ ID NO: 590 - protein, 502 aa, S. lucknowense; identical to SEQ ID NO: 578

SEQ ID NO: 591 - DNA, 1455 bp, S. maltophilia
atgcgcccccccattttccttgtgttcctgctgctggttgccgccgacgtgcgcgcccagcaggatgatctgcgccgcgtgctcgaacagggcagcgaactgcgccaccagcagcaggaccagcagcgcctgcaacaggccgaatcgcaacggccgacgctcaccatcgatggccagaccgtgcgggtggagcgcaccgtcgatgatctcggccaggctctctacttgtcattgcagcatcagcagtggccagccgccgcggcgttcctcgccgaatacatcgagcttccggggcacgacccgctgctgcgccattatgcgcagggtgcgttggcccgcgtggccggcgaccattcgcgcgctgcacaggagtacgaagcgctgctggcagcgcagccggacttcctgcccgcccgcctggaactggcgcgtgtctatgccgaagaccagcgcgaccgcgaggcggtggcattgttcggtgctatcaaggccggtatcgacagcaacgatccggccaccgcgggtgtgcgcgcacgcgtggacagctatctggtcgcgttgcaggcacgcgggcgctggaagggtgcggtcgccgccgggcctgcatggagcgacaacatcaaccgcagttcggccagccgcacctgcctgttcggtgtcggcaacacctgcctgatcgaacgcacgctgcccgaggcgcagcgcgccaccggcctggactacgacgccagcctggaacggcgctgggcgttggcaggccatcatggcctgtacgtgcgtgggctggcgttcgggcaggcctggcgtggctacagcgcatacaacgagctcaacgccagcgtgcaggccggctacagctggcgcagtgcacggcacaccctgcagctggcgccgagctatgactaccaggcgctgggcaaccacgccctgcagggcggcagtggcgtgcacggcgaatggcagtacgccctggacgcgcgcagcctgctcaagctggaggccgactggaaacgccagcgctaccggcagccgggcctggccgacaactacgatggcgaactggccgcgctgtatgccacctggttccgcgcgctcaacccgcgctggaccctgttcgcgggcgtggacctgaccgacagcagtgcagccgaccccgccaacggctaccgccagcacggcctgcggctgggcgcggcacggcagtggagtggcaccacggccacggtgttcgtgtcgttgcgtcaccgtgactatggtgcctggagtcctttgctggaggcgcgcaggcaggacgacgaacagaacctgatcgccatcgtgcgcagcgagcggctggcggtgggcgggctggtgcccagcctgagcctgcgctacgcctgcatcgacagcaacgtcggttggctgtacagccatgaccgcagcctgctcagcctgaaatgggagcgtgcgttctga

SEQ ID NO: 592 - protein, 484 aa, S. maltophilia
MRPPIFLVFLLLVAADVRAQQDDLRRVLEQGSELRHQQQDQQRLQQAESQRPTLTIDGQTVRVERTVDDLGQALYLSLQHQQWPAAAAFLAEYIELPGHDPLLRHYAQGALARVAGDHSRAAQEYEALLAAQPDFLPARLELARVYAEDQRDREAVALFGAIKAGIDSNDPATAGVRARVDSYLVALQARGRWKGAVAAGPAWSDNINRSSASRTCLFGVGNTCLIERTLPEAQRATGLDYDASLERRWALAGHHGLYVRGLAFGQAWRGYSAYNELNASVQAGYSWRSARHTLQLAPSYDYQALGNHALQGGSGVHGEWQYALDARSLLKLEADWKRQRYRQPGLADNYDGELAALYATWFRALNPRWTLFAGVDLTDSSAADPANGYRQHGLRLGAARQWSGTTATVFVSLRHRDYGAWSPLLEARRQDDEQNLIAIVRSERLAVGGLVPSLSLRYACIDSNVGWLYSHDRSLLSLKWERAF

SEQ ID NO: 593 - DNA, 1473 bp, S. melonis
atgcgccacgccgtctccccctatctcctgacgctcgccacgctgtggctggccgcgcccgcttccggccagagtgcccggagcgaggataaccgcctgcgtctcgaccccggtatcgatcgccggaccacggcccaggaccgcgaggcgatcgaggggggcagttcgccggatcgcatcaccatagatggccaagtctattcggtcggccataacccggacgatctgggccgggcgctgtacctgtcggtagcgcgcaagaattgggcggatgtccgccgtttcctgccaccgtatctggcactggcccgccatgatccgatgctggtcgcctgggcgcgcggcggcctcgcgcgcagtgacgggcggctgggcgaggccgagcgccagtaccgcgccctgctggcgatccagcctgacttcctgccggggcggctggagctcgggcgcgtgctgttcgagaaccgcaaggaccgagaggcccgccgcctgttccgcgcgatccgcgaagagctggcggggcagggcgagcaggccgccggggttcgccggacggtcgacaccttcctcgccgcgctcgaccggcggggcggctggcagggcatgatcgcggcggggccgggctatagcagcaacctcaaccagacgtccgccagccagacctgcctgctggtcggggtggacggcacctgcctgatcgaccgcaccctgccaccagcgatcgcctccgtcggcctcaacgtcgaggggagcgtcagtcgccggttcgcgctgaaggggcagggcgggctgttagcccgggccttcgtctatggcgatctctggcccgggcatggcgcattcgatcaagcgacgttgaccgcgcagatcggctatgatcatcagactgccaggcggagcctgaccgtgtcgccgaccgtcgacctggcgagcctgggtgatcggctgctctataccgcgcccggccttcgcgccgaggcgatggtcaccccgtcgcccgacaccgccctccggctggaggtcgcgcgccgggtcttcgattatcggcggagcttcgacgatctcgacggcgcgctgaccgaggcgtccctgaccggctggtggtcgcgcctgcgcagctggacgctgtttgccggtatcgaggcgggcgacaagcaggcgggggagcgcgccaatgcctatcgccatgtcggggcgcgactgggggtggtgcacggctttgccgactgggccgaactgacgctgatcggatcggtgcggcagcgcgattacggggcctatagcgaattgctggaggccgtccgccacgaccgagagacgaacctgaccgccgtcctccgcctacccaagctacgcctcgccgggctgacgcccaacatccttctccagcacaatcgggtgaagagcaatgtcgattggctctattcctttcatcgcaccgccgcgagcatcaggttggaacatgccttctga

SEQ ID NO: 594 - protein, 490 aa, S. melonis
MRHAVSPYLLTLATLWLAAPASGQSARSEDNRLRLDPGIDRRTTAQDREAIEGGSSPDRITIDGQVYSVGHNPDDLGRALYLSVARKNWADVRRFLPPYLALARHDPMLVAWARGGLARSDGRLGEAERQYRALLAIQPDFLPGRLELGRVLFENRKDREARRLFRAIREELAGQGEQAAGVRRTVDTFLAALDRRGGWQGMIAAGPGYSSNLNQTSASQTCLLVGVDGTCLIDRTLPPAIASVGLNVEGSVSRRFALKGQGGLLARAFVYGDLWPGHGAFDQATLTAQIGYDHQTARRSLTVSPTVDLASLGDRLLYTAPGLRAEAMVTPSPDTALRLEVARRVFDYRRSFDDLDGALTEASLTGWWSRLRSWTLFAGIEAGDKQAGERANAYRHVGARLGVVHGFADWAELTLIGSVRQRDYGAYSELLEAVRHDRETNLTAVLRLPKLRLAGLTPNILLQHNRVKSNVDWLYSFHRTAASIRLEHAF

SEQ ID NO: 595 - DNA, 1500 bp, S. muelleri
atgaaacgcgcttatcaaatactcacggtttatacattatcattatttgcgccgatgtgggcgtatgcggctgatgtgtccaatgatgcgccgccgtccgaacccatacccgatacgccacctgtcgcgccgcccgagcctgaaacagattttgatattactcaaaatcaacaacgtaaaaccgaaaatcaacagcccgaatccatacctgaaaccacacaatctgatggcagcaaacgtttacgcttgagtaaagacgaattggcaaagcagcctgaattattatatcgcgcattgtcgtcttcaattttgctgcgaaatgtggaaggcgtgcggacattgctgcccatctatcaagaacaaacgcaacaacctaaagatgaattattgattgatttgtctgaaggcatgattgcgcgtgatgatggcaatgcaggcaaggccgcgaaacattaccaaaaagcgttggaaaaaaatcctaatatggatttggtgcgattgaatttggcgcaagtcttatttgaagatcaccaaaatcgtgaatcagataaattatttgaacaaattcaatcagaaactgaattgcccaataatgtacgcgatttaacgcaaagttaccgcaaaatacttaaaaaacgcagcagaatgaatgcgtatgctcatgcaaattacacacgcaacaataatgttaacaactcacccaaagagcgcgttattcatacccgaaatggcgcgtggtatttgcctgaacctgaatcggcacaaggaatttcttatcgtgcgggtgtgggtaaagatacaccattattcaaaaattacacgtttcgtaccaatgcggatttgtggggtaaattttattgggataaccacaaatatgacgatttgagtacgcgtgccagtgtgggtgtggcgtatcaaaatgcgcgaagtgagatggcggtgttgccttattatgaacgccgttggtttggtacggagaaatatgccactgaaaaaggcatacgtttagaatcatcgcattggattacgccacgacatcaagctttagtcgcagccgaagttgggcgcgatacttatgatacgcgcaaatttctcaatggacgtgtcagtaatttatcggttacttggttacacacaccgagtaatcagcaatatttcacgttggggacggatttttcgcgtaaatccgcgcaagatagcagtgattcgtatcgccgtcaggggattcgggcgagttggtcgcggtcgtggaaacgcagtggtttggggacaactttgacggcaaattatgggcagcgcgaatacgataccaatgatttttttaatattgttcgcaaagacaaagaatattctgctacgctatcggtttggcataaaaaagtgcaattgtggggcattacgccacgtttggtaggtgtgtattatcgtaatgacagtaatcattttatgtacgattaccgtaaagcgtatgcgtttattcagttgagtaaatcattataa

SEQ ID NO: 596 - protein, 499 aa, S. muelleri
MKRAYQILTVYTLSLFAPMWAYAADVSNDAPPSEPIPDTPPVAPPEPETDFDITQNQQRKTENQQPESIPETTQSDGSKRLRLSKDELAKQPELLYRALSSSILLRNVEGVRTLLPIYQEQTQQPKDELLIDLSEGMIARDDGNAGKAAKHYQKALEKNPNMDLVRLNLAQVLFEDHQNRESDKLFEQIQSETELPNNVRDLTQSYRKILKKRSRMNAYAHANYTRNNNVNNSPKERVIHTRNGAWYLPEPESAQGISYRAGVGKDTPLFKNYTFRTNADLWGKFYWDNHKYDDLSTRASVGVAYQNARSEMAVLPYYERRWFGTEKYATEKGIRLESSHWITPRHQALVAAEVGRDTYDTRKFLNGRVSNLSVTWLHTPSNQQYFTLGTDFSRKSAQDSSDSYRRQGIRASWSRSWKRSGLGTTLTANYGQREYDTNDFFNIVRKDKEYSATLSVWHKKVQLWGITPRLVGVYYRNDSNHFMYDYRKAYAFIQLSKSL

SEQ ID NO: 597 - DNA, 1395 bp, S. muelleri
atgctaaccagttgggtaaccgccgcacctgttgctacaccctcagattctattgataatttaacaaaagaatcatcatacaatccctccgtgcaatttgctgtgccacaaaaacctatacacgatgcttataaaagtaaggtgttcatgaattcggaagaatttttgcaacacccagatttactcaaaaatgcactggataccgccattttgcgagaaaatacgagtgttgttcgttttttgttgccactttatgataggttgcctgaaaatcagcgcgacaaaacattaggtgaatatgcacacgctattgttgccagtgccgatggtcaatatgctcaagccgaacaacaattacgcgcattactcgtccaaaatcctgaatatgctccagttcgtttgcaattggcgcgcgttttggcgaaagatggtcaattgcgtgatgccgccaaagaaattgacacgctaaaacaaacacctgatatgcccaacgaaaccacgcaatatttagaacaatttgatcactatcttgtgaaagagcaagcgtggaaatttaatgctaatacctattatattcaagatgataatgtcgggcgtgtaccccagcagcgacaatatggctattggcgtttttctgaacctaaatccgcacacggtgtaggttatgacttgtctgctcaaaaaaacatgtctcttaaaggacattgggcgacacgtgttaatgtgtctacatcgggtaaattttattgggacgcgcacgattatgatgatttacaaacacatgctgaagtcggaacaatttggcgcaatgcaaaacgtgagatttcagtgagtccattttatgaaagacgttggtatggcagtaagccgtattcacacaatgcaggtggcgtattgcgttattcagaaattttgtcacccaaatggcaagtttggggcgcgtggcaatctgcatataaaaaacacgataaacgtcaatttttagatggtgccaatcatgcaggttcggttacgctggtgtatgcgcccgatccgaagcaatattttgtgatgggtggtggtagcggttatcaagcggcaaaagacaaatcggaagcatattcgcaaaccaatgcacgtgtgggttggcatcgtcagtggaaaaatacatttgatttaacaacagattttaattttttggtgcaatctcggcattatcaagcacctgattttttcaacatcaaacgacgtgataaagagtacatgacgcgtgtgagtgtgagttcgccaaagttttcgtggaaaggctttgagccgcgattgaattggacatggtcacgaattaacagcaaccatttttattatcgttacaagaatcatcgtgtatttattgatgtttctaaacaatttaaataa

SEQ ID NO: 598 - protein, 464 aa, S. muelleri
MLTSWVTAAPVATPSDSIDNLTKESSYNPSVQFAVPQKPIHDAYKSKVFMNSEEFLQHPDLLKNALDTAILRENTSVVRFLLPLYDRLPENQRDKTLGEYAHAIVASADGQYAQAEQQLRALLVQNPEYAPVRLQLARVLAKDGQLRDAAKEIDTLKQTPDMPNETTQYLEQFDHYLVKEQAWKFNANTYYIQDDNVGRVPQQRQYGYWRFSEPKSAHGVGYDLSAQKNMSLKGHWATRVNVSTSGKFYWDAHDYDDLQTHAEVGTIWRNAKREISVSPFYERRWYGSKPYSHNAGGVLRYSEILSPKWQVWGAWQSAYKKHDKRQFLDGANHAGSVTLVYAPDPKQYFVMGGGSGYQAAKDKSEAYSQTNARVGWHRQWKNTFDLTTDFNFLVQSRHYQAPDFFNIKRRDKEYMTRVSVSSPKFSWKGFEPRLNWTWSRINSNHFYYRYKNHRVFIDVSKQFK

SEQ ID NO: 599 - DNA, 1500 bp, S. muelleri
atgaaaaaatttagctcgttattgtgtgcagtgattttgtctgcacaatcaataacgtatgctgctgagaaatcgccagatattaacaatcattacttggaatcggagacaacgccagtagttactcaatccactacgccatctgatgatgataaattacgcggtcaaaaaatcagtactgatgttcagccagcaaaaaaaatggatttaaccgaaacagaatggcgcgctaaccccacaaaattacagcaaacattattattcttactggcgactaatcaagttaatcatctgaataatctacctgaattatatggtttattgccagcgaatacacgcgatgattcattaattgaatgggcacacgccatgcgtttgacacaaaccaatctaaggcaatctatccatgaatatcgtattttgctgggtaaatttcctgataatgattttattcgttttcaattagctgcattgctttatcaaaatcaagaatttgacgcagcaaaagggcaatttcaaaaactccgtgcatcaccacaaatgacagaaaaagacatgggagtatttgataaatatttgacagcgattgaaaataaagataagtggcatttttcattgggaacttcattgttaagagataaaaacttaactgaaatggctgccgaaggaaccgtgatgacattacctaatggcgctactttcacacaaattacccccaaagaatcaggaacaggtttcaattttggtgtcaatacagaaaaaagatggtccttacaaaatgggcaatatatcggactagcaggtagtggcaatttaaaatactactggaataatcataaatttaatgaattaactggctatattggtacaagttatggttatgccaattctaatattgaaatgaaagcaacgccttattatatgaaacgttggtatgctggcggtggcagtaatgattcagataaattaaaatcttatacccactcactagggatatcaacttctttggcggcatggttgacacccactttgaaacactcaacctacgccaactattcgcatgaaacttatgctaatgataatatggataaacgctacggcggaaatattaaaagtgtgggtacatcgttattgtatttacgcggtacaaaacagtattttggttcaagtttggatttaatgcgccgtgatgtgggtactgaaacgaattcgtataaacgttatggtgggcgagtattttggggacaggagtggcccaaaggttttgcaacacaagccagcctaagtttggcaaaacgaaaatatcaagctccttggcttggtattgtgcgccgtagtgataaagaatggaatgctaatgtgtctttatggcataaagcggttcatttttatggtgttacaccgcgtttgacttttaattatcaaaaaacaaaaagtaatattcctatctattcatatgataaaaatattacttatattgaattagataaatcattttaa

SEQ ID NO: 600 - protein, 499 aa, S. muelleri
MKKFSSLLCAVILSAQSITYAAEKSPDINNHYLESETTPVVTQSTTPSDDDKLRGQKISTDVQPAKKMDLTETEWRANPTKLQQTLLFLLATNQVNHLNNLPELYGLLPANTRDDSLIEWAHAMRLTQTNLRQSIHEYRILLGKFPDNDFIRFQLAALLYQNQEFDAAKGQFQKLRASPQMTEKDMGVFDKYLTAIENKDKWHFSLGTSLLRDKNLTEMAAEGTVMTLPNGATFTQITPKESGTGFNFGVNTEKRWSLQNGQYIGLAGSGNLKYYWNNHKFNELTGYIGTSYGYANSNIEMKATPYYMKRWYAGGGSNDSDKLKSYTHSLGISTSLAAWLTPTLKHSTYANYSHETYANDNMDKRYGGNIKSVGTSLLYLRGTKQYFGSSLDLMRRDVGTETNSYKRYGGRVFWGQEWPKGFATQASLSLAKRKYQAPWLGIVRRSDKEWNANVSLWHKAVHFYGVTPRLTFNYQKTKSNIPIYSYDKNITYIELDKSF

SEQ ID NO: 601 - DNA, 1452 bp, S. paucimobilis
atggctagcgccatgacaagcacagcccacgcgcagacatcaggcagcgccgatacacggctgcgtcttgaccaaagcttcgaccggcaaagcgccgaggccgaacggcagttgctggaggatgcggacgatctggacggcactccatcgaccatagagatcgacggcaagacctacgccgtcgccaataccatccacgaggttggcgaggcgctctatgtcgccattgcacgccggcaatgggccgatgtgcgacgattcctgcacgcctatctggcctttgaagagcgtgacccgatgctcgttgcctatgcacaaggagcgctggcgcgaaccgtcggcaagctgggcgaggccgagcgtcattatcggacgcttcttggcctgcagcccgatttcgtgccgggccagcttgaactggcgcgggtgctgtttgagaatcgcaaggatcgcgaagcgcgccgcatgttcgaaaccgcccgtgccgtcctggcggacgacggcgacaaggccgcaggcgtcctgcggaccatcgacagctttactcaagccctcgacaagcggcgaggctggcagggctcggtcgccataggcccgggctacagcagcaacctcaaccagtcgtcggccagctacacctgcttgctcgctggggatgatggcacttgcctcatcgaccgcaaggtgcccgatccgattcgagcggcgggcatcaacttcgagagcaatgtcagccgccgcattccccttcgcgggcatagcggtataacgggccgcgcgctgttctacggcgacatctatcccgatcacggccgttacagccagacgacgctgacgacgcaactcggctatgactatcgcaccgcccgggcaagtgtcacgctctcgccgagcttcgacctcggctccctggggtcggacatcctctacgacgccatcggcatccgtgccgagacgatgatcaatccttccgccacgtctgcgatccggatcgaggccagccgtcgctggttcaactatcgccttccatcctatcggaattatgatggcgcgctgaccgaagctctgctgactggttggaaagtgcttccgcgcggctgggcattgtttgcaggccccgattttgccgccaaggaagccgatgatccgatcaacgcctatcgccaatatggtttgcggctgggagtgaacaagcagttcggacgggcggtcagcctgctcgccttcgcgtcattccggcagcgcgattatcgggcttacagcgaactgctcgaggccaagcgccgtgaccgcgaacagaactatatcgccaacattcgttttccagcgctgcggttcgccaacctgacgcccagccttctcgtccagcacagccgcgtcagcagcaacgtcgattggctctactcttatcggaaaaccagcgtggccatgaggatggactatgccttttag

SEQ ID NO: 602 - protein, 483 aa, S. paucimobilis
MASAMTSTAHAQTSGSADTRLRLDQSFDRQSAEAERQLLEDADDLDGTPSTIEIDGKTYAVANTIHEVGEALYVAIARRQWADVRRFLHAYLAFEERDPMLVAYAQGALARTVGKLGEAERHYRTLLGLQPDFVPGQLELARVLFENRKDREARRMFETARAVLADDGDKAAGVLRTIDSFTQALDKRRGWQGSVAIGPGYSSNLNQSSASYTCLLAGDDGTCLIDRKVPDPIRAAGINFESNVSRRIPLRGHSGITGRALFYGDIYPDHGRYSQTTLTTQLGYDYRTARASVTLSPSFDLGSLGSDILYDAIGIRAETMINPSATSAIRIEASRRWFNYRLPSYRNYDGALTEALLTGWKVLPRGWALFAGPDFAAKEADDPINAYRQYGLRLGVNKQFGRAVSLLAFASFRQRDYRAYSELLEAKRRDREQNYIANIRFPALRFANLTPSLLVQHSRVSSNVDWLYSYRKTSVAMRMDYAF

SEQ ID NO: 603 - DNA, 1158 bp, S. pontiacus
ttgctcgaggggtattcacccaagaccgagacagagaccctgcgccggatgtggattctaggggtcgcctacaaccgttccggaaaatcacgccaagccgttgccccgctggcgcggcttgtgatcttgcggccagacgatcccacgttccggcttgagctggcgaacgcattggtgaaaagcgaccagttcgaacgggcgcgatatcaccttgaactggccaaaggtgcgggtttgtcgccccctgtccaggcaaaagtacaggcggagctggaccgtttggccaaaccgaaaaaatggcagggctatttccgttttgccattgtgcctgaaagcaatgccgcccgccggacctctgcagagacggtgaacctcagcggctttgtgctgcggctggacccgaattcccgcgcccaatccgccacagcgttcgagattggcacgggcgtcgcgaccgtgccgcgtcttacggacgccttacgcgccaggttcgcgctggatctggatgcccggcttttcgacggacgtgcgcctgatgaagtgacccttcggaccagtgcatccctgctgcatttcgccgatgaggggcgtcttgtcttggccgagatctatggatcgcagcgctggattgatgacgcggcctatacgcataccttgggccttggcctgtcctatacgcgcaacctcggcacccgcgcccgcgccacggcggtgcttcagcgcgaacgtatcacctatgatggcagcggtgtcggcgtggaccgaacagcaggcgctgcgcaattcgcgtacgcggcatcctcgcagcttgtgtttcgcgtaggcatgcgcgcggaaaaccgtgccagctcttacagccccgtcgcgggccatgcggcgggcgtcaccatcggcggcgactattcctttgccggcggccttcgggttgggctggatctgtcgtttgatcggaacgaatttgacggcgtgcatcccatcttcggcgttgcccgcgtcgacaagaaatcaagcgtcatgctgaacctgtccaaccagaactggagctacaagggctttacacaggttctgaggctcgggtttgaggagcaacgctccaccatttcgatcaacaggtttcgcaacgccactgccagcatcggcctgacacgatcgttttga

SEQ ID NO: 604 - protein, 385 aa, S. pontiacus
MLEGYSPKTETETLRRMWILGVAYNRSGKSRQAVAPLARLVILRPDDPTFRLELANALVKSDQFERARYHLELAKGAGLSPPVQAKVQAELDRLAKPKKWQGYFRFAIVPESNAARRTSAETVNLSGFVLRLDPNSRAQSATAFEIGTGVATVPRLTDALRARFALDLDARLFDGRAPDEVTLRTSASLLHFADEGRLVLAEIYGSQRWIDDAAYTHTLGLGLSYTRNLGTRARATAVLQRERITYDGSGVGVDRTAGAAQFAYAASSQLVFRVGMRAENRASSYSPVAGHAAGVTIGGDYSFAGGLRVGLDLSFDRNEFDGVHPIFGVARVDKKSSVMLNLSNQNWSYKGFTQVLRLGFEEQRSTISINRFRNATASIGLTRSF

SEQ ID NO: 605 - DNA, 1281 bp, S. pontiacus
atgaaacatcttctttttgccgccctgatgggcgttcttttggcgtgccagtcgcccggacaggcgcaggccgcgacaccacaggactatctggaacagggaaactatgacgccgcgcgggccagtctggcgcagttggtcaagggggatccgaacgggcccttgcatcaggcctatctggaaggtcaaatcctgatgcgccagaaccagcctgcggcggcggttgatctgtttcgcgatctggtgcgcatcgcgcccgattatgaaccggcaagacgagagctgaccctgctgctggcctatcgcggtgacgtgaccgctgcgcgctatcatgcggaacggttggtcgcggaaaccgccgacgaacagctgcgcgccggattgcagacctttatcctgaacaatacctcgcgcaagcccggcggctttgccctgcggttcgcgctgttgccgtcgtcgaaccagacccgcggcagtgccgagcaggaaatcctgattggcggggtgccgttcacgctgaaccctgcgtcgcgcgcgtcttccggggtggggctggcgattggcggcaccgcgtggcggcgctggcagtggaatgaaagatggtccggcgtgggcacggccagtttggatgcgaaattctacgattccgcgctgaacacggaaaccacggccgtcgcacggttcgatgtcattcgtggcgggcagcgggggcggttctctttcgggccgattgccgagctgagcttttctgattcagacatcgtgcgacgacggtggggggcggagctgcgcggagcctatcagctgcgtccgcgtgatctggtgtcgggtgcgctgcggtttgaccggcagacctatgaccaaagcccgtttcgtgacgggcaccggatgcgggcttcggtctcgtaccaacatcggttgacgccgacgctcgggctgtccttcggcctgtcgcagctgcgcgagacgacacagcgcgcgcatctggatcaccatgaaaccggcgtgtcgatggggatcgacaaacagtggaaatcgggcctctcgaccggcgtgatactggcatacgaacaggacagatacgacggcatcttccccggcaccacgaccccgcgcgaggatgataccaccagcctcaccttcaccgtgcagcacaacaaggtgcagatcgggaaatacgtgccgcgcatcacctatacctacacgcgggcgaaatcgaatgtggcgttgttcgactatgacagccacgacatcggggcgagtctctcgctcaagttctga

SEQ ID NO: 606 - protein, 426 aa, S. pontiacus
MKHLLFAALMGVLLACQSPGQAQAATPQDYLEQGNYDAARASLAQLVKGDPNGPLHQAYLEGQILMRQNQPAAAVDLFRDLVRIAPDYEPARRELTLLLAYRGDVTAARYHAERLVAETADEQLRAGLQTFILNNTSRKPGGFALRFALLPSSNQTRGSAEQEILIGGVPFTLNPASRASSGVGLAIGGTAWRRWQWNERWSGVGTASLDAKFYDSALNTETTAVARFDVIRGGQRGRFSFGPIAELSFSDSDIVRRRWGAELRGAYQLRPRDLVSGALRFDRQTYDQSPFRDGHRMRASVSYQHRLTPTLGLSFGLSQLRETTQRAHLDHHETGVSMGIDKQWKSGLSTGVILAYEQDRYDGIFPGTTTPREDDTTSLTFTVQHNKVQIGKYVPRITYTYTRAKSNVALFDYDSHDIGASLSLKF

SEQ ID NO: 607 - DNA, 1473 bp, Sphingomonas sp. S17
atgcgatacttcgccctttcttcgatcctggccctgatcgcctgtccccttgccatgcccgccttcgcccagagcgcgcgcagcgaggacaaccgcctgcgtctcgaccccggtatcgatcgccgtacgacgccgcaggaacgcgaggcgatcgaagccgccacgccatcggatagcatcaccatcgacggcgaggtctatcgggtcgatgatacgctcgacgatctggggcgtgcgatctacctgtcggtttcgcgcaaggcctgggtcgatgtccgccgttttctgccgcgctatgtggcgctgtccgggcatgatcccatgctggtcgcctgggcacgcggcggtctggcgcgcagcgaggggcggctgggcgaggccgagcggcattatcgcgcgctgctggcgatccagcccgactttcttcccggccggctcgaactcggccgcctgttgttcgagaaccgcaaagaccgcgaggcgcgccgcctgttccgcgcgatccgcgacgaattggcgagacaggatgatcgcgccgccggggtgcgccggaatgtcgacgccttcctcaccgcgctcgaccgtcgcgatcagtggcagggcatgatcgctatcgggccgggctatagcagcaacctgaaccagagctcggccagccagacctgtctgttgaccggtgaggacggcacctgcctgatcgaccgcaccctgccgtctgcgatcgcgtcggtcggcatcaatatcgagggcaatctcagccgccggattgcgctgaaggggcaggggggattgctcgcccgcgccttcgtttacggcgacctgtggcccggccatggcgactttgaccaggcgacgctgagcgcacagatcggctatgaccatcagaccgccagacgcagtctgaccctgtcgccgaccatcgatctggcgagcctgggcgacaagctgctctatgccgcgccgggcctgcgggcggaggcgatggtcaccccgtcgcccgatacggccctgcggattgaggtcacgcgccggattttcgactatcatcgcggtttcgacgatctcgacggcgcattgaccgaggcgaacctgaccggctggctctcgctgccgcgcggttggagcctgttcgcgggcctggatgcaggggacaagcaggcggatgcccgccccaatgcctatcgccatatcggtgcgcggctggggatggtgcacggttttgccgactgggcggaactgaccctcatcgcctccgcccggcagcgcgattaccgcgcctatagcgaactgctggaggcggtccgccacgatcgcgagaccaacctgaccgccgtcctgcgcctgcccaaactgcgcttcgcggggctgacgccgaacatcctttttcagcacaaccgggtgacgagcaatgtcgactggctctattcctttcatcgcaccgcggcgagcttccggctcgaacatgcgctctga

SEQ ID NO: 608 - protein, 490 aa, Sphingomonas sp. S17
MRYFALSSILALIACPLAMPAFAQSARSEDNRLRLDPGIDRRTTPQEREAIEAATPSDSITIDGEVYRVDDTLDDLGRAIYLSVSRKAWVDVRRFLPRYVALSGHDPMLVAWARGGLARSEGRLGEAERHYRALLAIQPDFLPGRLELGRLLFENRKDREARRLFRAIRDELARQDDRAAGVRRNVDAFLTALDRRDQWQGMIAIGPGYSSNLNQSSASQTCLLTGEDGTCLIDRTLPSAIASVGINIEGNLSRRIALKGQGGLLARAFVYGDLWPGHGDFDQATLSAQIGYDHQTARRSLTLSPTIDLASLGDKLLYAAPGLRAEAMVTPSPDTALRIEVTRRIFDYHRGFDDLDGALTEANLTGWLSLPRGWSLFAGLDAGDKQADARPNAYRHIGARLGMVHGFADWAELTLIASARQRDYRAYSELLEAVRHDRETNLTAVLRLPKLRFAGLTPNILFQHNRVTSNVDWLYSFHRTAASFRLEHAL

SEQ ID NO: 609 - DNA, 1386 bp, S. taxi
ctgcgcctcgaccagaccgtcgagcagcgcaaggccgaggccgaaacgcgggtgcgcgacgagaccgagcggctcgatccgaccagcgtcgagatcgacggcaccacctatgccgtcggccgcaacgccagcgacacgggcgcggcgctctacgtctcgatcatgcggcgacgctgggcggacgtgcgtcgcttcctcgccgcctatcgcgccctccccggtcacgaggacgggctgatcctctacgccgaaggcggcctcgcgcgcgaggcgggcgacatggcgggggcggagcgcgcctatcgcgcgctcgtcgcggcgcagcccgatttcgtgcccggccggctcgaactggcgcgcgtgctgttccttgaccgccgcgatcgcgaggcggcgcaggccttcgccggcgtgcgcggcgcgctgctcgcgcagggcgacaaggcggcgggcgtggtgcggacggtcgacacctttctcgccgccctgcgcaaaaggcgcggcgtgcagggcatggtgtcgttcggccccgaatacagctccaacctcaaccagtcgtcggcgagctatacctgcctgatccccggcgcctcgggggattgcctgttcgaccgcaaggtgcccgatccgatcgccgcgcgcgggatcaatatcgagggcaatgccacgctgcgcctgccgctcgccggccatgacgggatcggcggccgggcgctcgccttcggcgatctctttcccggccacggccgctacagccagaccgcgctgtcgctgtacgcgggctacgaccgccgcaccgccgctaccgggctggtcctcgccccctcgttcgatctcggcacgctggggggccagcggctctacgatgcctggggtctgcacggcgaatatagccgcgggttcgggtcgcgcacgctcgtccgggtcgagggcaactggcgcgactatcgctaccggcgcgacggttatcgcgattacgacgggcggcaggcggatgcgtggctgaccggcttccacacgctgccgcacggctggacggtgttcggcgggccggatctgctcgacaagcgcgccggcgatcgggtcaacgcctatcgccaatatggcgcgcggctcgggctcgaccggacgatcggcgcggcggtcgacctgctgctgaccgcctcgctccgccgccgcgactatggcgcgttcagcccgctgctcgacgccagacgccgcgacgtcgagcggaattacacgatgctcgcccgcctccccggcgcgaaggtcgcgggcctcagccccagcctgctcgtccagcacagccgcgtcggcagcaacgtcgactggctctattcctaccggcgcaccagcgtcagcctgaggatggatcatgtcttctga

SEQ ID NO: 610 - protein, 461 aa, S. taxi
MRLDQTVEQRKAEAETRVRDETERLDPTSVEIDGTTYAVGRNASDTGAALYVSIMRRRWADVRRFLAAYRALPGHEDGLILYAEGGLAREAGDMAGAERAYRALVAAQPDFVPGRLELARVLFLDRRDREAAQAFAGVRGALLAQGDKAAGVVRTVDTFLAALRKRRGVQGMVSFGPEYSSNLNQSSASYTCLIPGASGDCLFDRKVPDPIAARGINIEGNATLRLPLAGHDGIGGRALAFGDLFPGHGRYSQTALSLYAGYDRRTAATGLVLAPSFDLGTLGGQRLYDAWGLHGEYSRGFGSRTLVRVEGNWRDYRYRRDGYRDYDGRQADAWLTGFHTLPHGWTVFGGPDLLDKRAGDRVNAYRQYGARLGLDRTIGAAVDLLLTASLRRRDYGAFSPLLDARRRDVERNYTMLARLPGAKVAGLSPSLLVQHSRVGSNVDWLYSYRRTSVSLRMDHVF

SEQ ID NO: 611 - DNA, 1347 bp, S. yanoikuyae
ttgggggattctatcagattcgcggcgcgtcttgtcgcgtcggtgctgtgcgtgccgatgtcggttgccagtgcgcagcatgtcgatgcggaacgcgcatcgacacctgccatcctgtcggccggacagattttcgacgttgccgaatccgcgcgacaggcacgcgatttcgaaaccgcccaggcggcctatcgcgccctgttcgccgatgccgatcccgagttgcggatcgaagcgcgcttccggctggggctgatgctggccgacgacctgcaacgctacagcgatgcggcggtcgagttccgggatatccttgatgtaaaaccccatgccgcccgcgtgcgcttggaactggccagggtgctggctgccagcggtgacgtgcgggctgccggccgcgaaatgcgcgcggcacaggccgccggcttgccgtcacaggtcgagcagatggtgcgcttctatgccaatgccttgagcgcacggaaggcgctcggcggttcggtcgaactggcccttgcgcccgacagcaatgtcaatcgcgcgacccgttccgatcggcttggaacggtgatcggcgatttcctgctcgacaaggatgcccaggaaaaatcaggcgtcgggctcagtctgcgcggacagggctattggcgccacggcatcgaaccgggcgcggatctgctggtgcgcgcgtcggtcggcgcctcgctctatcgcgatgcctctttcaacgacatcagtgcggcgttgcaggtcggcccccaatatctgtcggggtcggatcgtatcaccgtggcggtcgggccaagctggcgctggtatggcggccgtctctattcgaccggctatggtggcagcgcgaacctgctgcacccggtgggaaaacgtagccaacttcagcttgaaggtggcatcacccatgtccgcaaccagcgcaacgccttgcagacatcggatgattttaccctggccggggcatttgatcatgccttcagcgcgcggggcggcggcggcgttcagatgtttgccctgcgcgaagcagcgcgcgatcccggttatagtttcgtcagtggtgggggcagcgtctatggcttccgcgaaatggggcgcacgaccttcgtcgcgacaatgggatacagccatttggaggctgatgcccggctgcttctttatccacgccggcgcatcgaaaatcgattgagcgcgagcatcggggcgacgttacgcgccttgcaggtcggtccgttcgcgccactggcgcggctcaaatgggaacgcaatcgctcgaccatcgaaatctatcaatatcgccgaatttctgccgagttcggcatcggttcggttttctga

SEQ ID NO: 612 - protein, 448 aa, S. yanoikuyae
MGDSIRFAARLVASVLCVPMSVASAQHVDAERASTPAILSAGQIFDVAESARQARDFETAQAAYRALFADADPELRIEARFRLGLMLADDLQRYSDAAVEFRDILDVKPHAARVRLELARVLAASGDVRAAGREMRAAQAAGLPSQVEQMVRFYANALSARKALGGSVELALAPDSNVNRATRSDRLGTVIGDFLLDKDAQEKSGVGLSLRGQGYWRHGIEPGADLLVRASVGASLYRDASFNDISAALQVGPQYLSGSDRITVAVGPSWRWYGGRLYSTGYGGSANLLHPVGKRSQLQLEGGITHVRNQRNALQTSDDFTLAGAFDHAFSARGGGGVQMFALREAARDPGYSFVSGGGSVYGFREMGRTTFVATMGYSHLEADARLLLYPRRRIENRLSASIGATLRALQVGPFAPLARLKWERNRSTIEIYQYRRISAEFGIGSVF

SEQ ID NO: 613 - DNA, 1508 bp, S. yanoikuyae
atgatttttgggtcactcctgccccgaccaaacgcccccctcggtttgctcctgctcatcatggcaggtacgccagctactgcgctcgcgcaaattgacagcgggcaggacacgcggctgcgcctcgatcaacagctcgatcgacagcgagcggcacaagaggagcgttcgctcaacgaggtggacgaagggctcgatgccccttcctcgctcgtcatcgacggaaagacctacgctgtcggcaacaatgtcgatgagatgggccaagcgctgcacatcgcagtttctcgacggcaatggggagacgctcgccgtttcctcaaagcttacgaaaattttcctgatcgtgatccgatgctcatgctctttgcaaacggggcagtcgcgcgccaggacggaaagctagacgaggctgaaggcttctatcgtgaaatgttggtgctggacccgggctttgcatcgggccagctcgaactggcgcgcgttctgttcgagaatcgcaaggaccgcgaagcacgccagacttttgaaagcgcgcgtgcgctgctcgtggtcgacggcgacaaggcatcaggcgtgatcgtaacgatcgatgccttcttaaatgctctgcgccaccggcgaggctggcaaggcaatctggcgataggcccgatctacagcaccaacatcaaccaatcatcggaaagctacacatgtctgctggcgaccgatgatgggacgtgtgtggtcgatcggaaagtgcccgacgcgataaagggtacaggcatcaacgttgaaggggcgctcagccgatatcttccactgtccggtcatcatggcctacgcggccgcgctattctgttcggggaaatctaccctgaccatcatgatttttctcaaggcgtgtttataactcggttgggatatcaatatcagactggccgcaacactctcggcctgtcgccctcattcgacctcggcacgctcggatcatctgttctgtatgaagcctggggcgccaatgcggagtggcagcatacggcctcacgcaacgtcctattgcgccttgaagcgaattaccgggattttcgctatcgccttccaggttccagttcccaaacagggccgatggtggacgtcaatctgacggtctggtacgccccgtcgcaggattggaccttgtttggaggtcctgactttaccgacaaagacacacccagcccaacagactcctatcgccagttcggtgcgcgtttcggcataaacaagacttttggaagcgacgcgagcatccttttgctcggctcctatcgccatcgcgagcatcgcggctttagcgctttgttcgacgccaaacgccgcgaagaccagttcaacgcgacggccatcgcacgtttcccagcgctgagattcgcggggctgacacccgagatcgtggtccagcacaatcaggtcaaagcaacatcgactggctcttttcctacaagcgcaccaccgcgagcgtgaggctcggctatgccttctag

SEQ ID NO: 614 - protein, 502 aa, S. yanoikuyae
MIFGSLLPRPNAPLGLLLLIMAGTPATALAQIDSGQDTRLRLDQQLDRQRAAQEERSLNEVDEGLDAPSSLVIDGKTYAVGNNVDEMGQALHIAVSRRQWGDARRFLKAYENFPDRDPMLMLFANGAVARQDGKLDEAEGFYREMLVLDPGFASGQLELARVLFENRKDREARQTFESARALLVVDGDKASGVIVTIDAFLNALRHRRGWQGNLAIGPIYSTNINQSSESYTCLLATDDGTCVVDRKVPDAIKGTGINVEGALSRYLPLSGHHGLRGRAILFGEIYPDHHDFSQGVFITRLGYQYQTGRNTLGLSPSFDLGTLGSSVLYEAWGANAEWQHTASRNVLLRLEANYRDFRYRLPGSSSQTGPMVDVNLTVWYAPSQDWTLFGGPDFTDKDTPSPTDSYRQFGARFGINKTFGSDASILLLGSYRHREHRGFSALFDAKRREDQFNATAIARFPALRFAGLTPEIVVQHNQVKSNIDWLFSYKRTTASVRLGYAF

SEQ ID NO: 615 - DNA, 1326 bp, Sagittula stellata E-37
atgatgacaaggctcgcggcacttggcgtgcggcgcctgctcgcgggcctttttcttgcactggcgcttgtgtcgcaagcaccggcgcagcagtctgacgtgcttgcccgtgccgaggcgcaggtaaatgccggagactatggcaccgctatctccgccctgcagagaatggggcctcaagcgttgcgcgaggccgagttgcgccgtctctgggcgctgtccatggcgcatgtccggcagggccgtccacgcgcggcactgccctggctggaccgactggtctcccttgcgcccgatgccgtcacctaccgtctggaactcgccaacacgctcgaggctgcggggcaggcagagcgcgcgcgctaccactattccctggcgcgcggcgccgcgctgcccccgtcgctggccgacgaggtgacgcggcgcatcgaccagattgatcgtgcccggatctgggaaggcaatttccgcttcgcgatcgtgcccgagagtaatcccgcgaaacgaaccgcggccgacaccatcatgatcggcgacctgcccttcaagctcaaggacgcctcccgcgcacagcccgcccggggtgtcgaacttggcttcgggcttgccgccctgcccagggtgggaccggatctgaggcttcggctgggggcgtccctcgatgcacggctttacgaagaaggtgcgcccgacgacgttcaggcacgggcggaactggggttgctgcacttcggcgaccgcaaccgcagactgggcgccgggatcactctgggaaagcgctggatcgacggcgaggcatacgccaacacgcgtggcatctatctgacctggggccagtccatcgacgcccaggcccggagcatgcttaacctgacgctgatccgcgagcgcaccgactatgaacgccccggaaccgagcccgccacccgatccgtagcagccgcatcgctcagccacacggttacaccccggttgcaactcagtttcggcttgcaggtggagcggaccgaaagcgcgcttgcaaccgaagccgggcaggggggggcggtgacgcttggcgcgcgctacgccttcgagggcgggctgctcgccgagttgtcactggcgcttggtcggcacgaacgcgatgggcctgaccgcctgcttggaattgtacgtaaggaccagcgcgagagtctcaccctgaagctcacacaccgcgactgggcggtcgcgggctttgcgccggtactcgaactcggagcagagcggcaggactcgagcaacgacctctacagctacgagaacaaccgtgtgctgctgggcatcacccggcggttctga

SEQ ID NO: 616 - protein, 441 aa, Sagittula stellata E-37
MMTRLAALGVRRLLAGLFLALALVSQAPAQQSDVLARAEAQVNAGDYGTAISALQRMGPQALREAELRRLWALSMAHVRQGRPRAALPWLDRLVSLAPDAVTYRLELANTLEAAGQAERARYHYSLARGAALPPSLADEVTRRIDQIDRARIWEGNFRFAIVPESNPAKRTAADTIMIGDLPFKLKDASRAQPARGVELGFGLAALPRVGPDLRLRLGASLDARLYEEGAPDDVQARAELGLLHFGDRNRRLGAGITLGKRWIDGEAYANTRGIYLTWGQSIDAQARSMLNLTLIRERTDYERPGTEPATRSVAAASLSHTVTPRLQLSFGLQVERTESALATEAGQGGAVTLGARYAFEGGLLAELSLALGRHERDGPDRLLGIVRKDQRESLTLKLTHRDWAVAGFAPVLELGAERQDSSNDLYSYENNRVLLGITRRF

SEQ ID NO: 617 - DNA, 1344 bp, Salmonella enterica subsp diarizonae
atgaaaattatcacattcatgcgactgaagccgggaaaaccaccagctatggtctcttttatatttctcctgttttccacctttacatcagcaaaagaacaaactctggagacgggaaatctaaacaacaaattaactcactatttaattagcaataattctgtggcagtaaaaaacatactacagacctgtggagaatgttcacagttcattgacccacttttgctcgaatgggctaatggcattcttgctcgtcaggaaaaaaactacgccgaatcaatacggcattacagaaaagtcatctctgtacatcctgactggtacagtgccagattacaactggccacagtattgtacctgaataaagatatactgtccgctgaagctcagttacgtaaattacgcagtgaatctttacctgaagaagcagccgtactgattgactccttcattgcaaaaatacaaaagacagacaactgggcatttcgtggcggattcacttatctgaatgaaaaaaacatcaataacgcgccagcatccggtcgttccatcggtcgatggaaatctgagaaaccacaatcaggaaaaggtgtgatgttttggggagaggcagaaaaaacattctctttgccggataatctttttggtatcacacgattagccacctcagggaaagtatacaaaaataaccactcttatgatgagcttgatggtagtatcggactgggttttggttatcgcaatattgatactacgattcttctccttccattttatgaaaaaagttattatggcggaggcaaaaaatcagaaaaaggtctgaaaccttattctgatacccgtgggttcggagtagaaaccacgctccagctttcaaaccgctggcgtttatactcagacgttaaactgggtaaaaatgaatataaaaaaaagacttaccttaacggataccgctactcacttaatgaaactctgatttatttcccagattcacgccagtatatttctgcaggtcttggatacagtatgctcagaactgaagaaaaagacagttctttcaataaggcagcattccggaccggatggatgtacgaatggaatggaggtgtatcaacgctattacaggctgcttatggtcataaaaaatacctggccggagacttctggggaataaagcaaattaatcatgaatacaatacttctgtcacggtatggcaccgcgatatttatttttttggcataacaccaaaaatcacatggagttatcagcgaactgacagtaatcatccttttcacgacacggagaggaatcgtcttttgctgagtttcagcaaatacttctga

SEQ ID NO: 618 - protein, 447 aa, Salmonella enterica subsp diarizonae
MKIITFMRLKPGKPPAMVSFIFLLFSTFTSAKEQTLETGNLNNKLTHYLISNNSVAVKNILQTCGECSQFIDPLLLEWANGILARQEKNYAESIRHYRKVISVHPDWYSARLQLATVLYLNKDILSAEAQLRKLRSESLPEEAAVLIDSFIAKIQKTDNWAFRGGFTYLNEKNINNAPASGRSIGRWKSEKPQSGKGVMFWGEAEKTFSLPDNLFGITRLATSGKVYKNNHSYDELDGSIGLGFGYRNIDTTILLLPFYEKSYYGGGKKSEKGLKPYSDTRGFGVETTLQLSNRWRLYSDVKLGKNEYKKKTYLNGYRYSLNETLIYFPDSRQYISAGLGYSMLRTEEKDSSFNKAAFRTGWMYEWNGGVSTLLQAAYGHKKYLAGDFWGIKQINHEYNTSVTVWHRDIYFFGITPKITWSYQRTDSNHPFHDTERNRLLLSFSKYF

SEQ ID NO: 619 - DNA, 1239 bp, Sphingobium baderi LL03
atgcggctatcggccgcgcaagtattcacgttggcggatgccgcgcgcgccggtggcgatttcgcggcagccgagacggcctatcgcgcgctccagtccgaccctgatcttgagattcgaacagaggcgcgtttccgtctcgggatgatgctggctgacgatctgcgccgttatagcgacgcggcaatcgagtttcgtcacatccttgacgaccaacccaaagcagcacgggtacggctggaactggcgcgcgtactggccctgatgggccatcttggtagcgcggaacgcgagtttcgcgcagccgaggccgctggcctgcctcctgaagtcgagcgcatggtccgcttcttcgccaatgctctgaacgcgcgaaaaaccttcggcgggtcggtcgaagtggcgctcgcgccggatagcaatatcaaccgtgcaacgcgctcggacacgctcggcacagtgattggggacttcacactcgacaaaaacgccaaagcgaagtccgggattggacttgaactgcgtggtcaggcctactggcgcaacaggctggagcatgacgccgacttgctggtgcgcggatcagttggcggcagcttttatggcgacaccagtttcaacgacatctccgcgagcctgcaagtgggaccgcaatacacatcgggcaaagaccgcatcacgttgtccacaggccccgtctggcgctggtatggccagcagccctatagtgtcggcctgagcggcacggcgaactggcaacatcccacgggcaaaagaagccagatgtctctggaaggcagcgctgcgcacgtcaccaacaaacgtaacagcctgcaaacggcagacaccttcacggtaagcgccagcctcgatcgcgccttcagcgcgcgttttggaggcggcatgcaaatctacggctttcgggagaaggcgcgcgatccgggttactcgctcgcgagcggcggtacgagcgcctacctgttccgcgagatgggccgcgccacgctcgtcggcaatatcagctacagccatcttgaaaccgatacacggcttttcctctatccacgccgtcgcatcgaagatcgttacgccgccagcctcgccgccacgctgcgcactcttcgcgtaggccccctcgcgccgttggtccgcgtcaagtgggagcgtaaccgctcttctatcgaggtctatgactataaacgtttttctgccgaacttggtgtgagttcggctttttga

SEQ ID NO: 620 - protein, 412 aa, Sphingobium baderi LL03
MRLSAAQVFTLADAARAGGDFAAAETAYRALQSDPDLEIRTEARFRLGMMLADDLRRYSDAAIEFRHILDDQPKAARVRLELARVLALMGHLGSAEREFRAAEAAGLPPEVERMVRFFANALNARKTFGGSVEVALAPDSNINRATRSDTLGTVIGDFTLDKNAKAKSGIGLELRGQAYWRNRLEHDADLLVRGSVGGSFYGDTSFNDISASLQVGPQYTSGKDRITLSTGPVWRWYGQQPYSVGLSGTANWQHPTGKRSQMSLEGSAAHVTNKRNSLQTADTFTVSASLDRAFSARFGGGMQIYGFREKARDPGYSLASGGTSAYLFREMGRATLVGNISYSHLETDTRLFLYPRRRIEDRYAASLAATLRTLRVGPLAPLVRVKWERNRSSIEVYDYKRFSAELGVSSAF

SEQ ID NO: 621 - DNA, 1509 bp, Sphingobium sp. HDIP04; identical to SEQ ID NO: 577

SEQ ID NO: 622 - protein, 502 aa, Sphingobium sp. HDIP04; identical to SEQ ID NO: 578

SEQ ID NO: 623 - DNA, 1404 bp, Sphingobium sp. SYK-6
atgaggcgccgcgtcgctgcggggctgggcatgatgagtgccgtcattgcgctcgccagcgccgccggccccgcccacgctcaggcggagagcgaagctgccccggatcgccccgaggccagcacgcctgcgccgacaccgcgcgtcacgcaggacggcgcggcactcagcggactgagcgcggcgcagcttttcgacattgccgatcaggcgcgcgttgccggacgccttgccgatgccgaagccatctatgccgcgcttgcgcgagacccggatggcgaagtgcgggctgaggcgcgcttccggctcggcatgatgcaggccgaccagggccgcaacgccgacgcagccctcacattccgcgccttgctggacgagcgccccaaggccgcccgtgtccggctggagcttgcccgcgtgcttgccgcgatgggcgaggaaggtcgggcgcgccagcagcttcgccaggcgcaagccagcggccttccgccggacgtggcgcaagtggtggaccgcttcgcgacagccctgcgctcgaaccggcgctttggcggcaatttcgagctggccatggcgccggacagcaacgtcaaccgggccaccgacgcgcgggagctggacaccgtcatcgcgccgctcaacctctccgacgatgcgcgccagcagtccggcataggcctgcacctgaccggccaggtcttcgcgcgcctcggcctgacaccacgcctgacgctggtgccgcgcctctccggcgatgggaccttctatggcaagagccagttcaatgatctttccggcagcgccctgctcggcttcgaatggcaagcgggcggcacgcgcctcatgccctccttcggcgccacgtggcgcacttatggtggcagggcctatgcgcgcaccgccacggcggatctgcgcctgacacagcgcgtcggccgccgcgcgcagagcgaagtcggcttctcctatggccggacgcattatctgttcaacgagatgcaggatggtgacctgttcaacctgagcgcggggatcgagcgcgcgctctctccccgcaccggaatcggcgtgacgctgagcggcacccgccagacggcccgcgaccccggcttctcgaccgcggcgggcggcgtgacgctgctcggctggcgcgacatgggccgaatgacggtctttggccatgtcacggcccggcgcctcgaatccgatgcgcggctcttccccttcacggaacggcgcaaggaatggttcctgcgcggcgcggccggcgcgacgttccgccagattgaggtggcgggcttctcgccggtggtgcgactcgcctacgagcgcaacatctcgaccgtcggcatctacgactatcgccgcaccaccatcgacctcggcattacgcgcgccttctga

SEQ ID NO: 624 - protein, 467 aa, Sphingobium sp. SYK-6
MRRRVAAGLGMMSAVIALASAAGPAHAQAESEAAPDRPEASTPAPTPRVTQDGAALSGLSAAQLFDIADQARVAGRLADAEAIYAALARDPDGEVRAEARFRLGMMQADQGRNADAALTFRALLDERPKAARVRLELARVLAAMGEEGRARQQLRQAQASGLPPDVAQVVDRFATALRSNRRFGGNFELAMAPDSNVNRATDARELDTVIAPLNLSDDARQQSGIGLHLTGQVFARLGLTPRLTLVPRLSGDGTFYGKSQFNDLSGSALLGFEWQAGGTRLMPSFGATWRTYGGRAYARTATADLRLTQRVGRRAQSEVGFSYGRTHYLFNEMQDGDLFNLSAGIERALSPRTGIGVTLSGTRQTARDPGFSTAAGGVTLLGWRDMGRMTVFGHVTARRLESDARLFPFTERRKEWFLRGAAGATFRQIEVAGFSPVVRLAYERNISTVGIYDYRRTTIDLGITRAF

SEQ ID NO: 625 - DNA, 1374 bp, Sphingomonas sp. LH128
ttgcaggggcaggagcgcaagacagagtcccggcttctcgaagatgccgacgcgctggacgggcccccgacgtcgctggagatcgacggcaagacttacgcggtaggcgataatgtcgatgagatgggacaggccctctatattgcgatccggcgccgcatatggagcgagggtcgccgttttctgacggcctatgagggatacacagatcgtgatcccaaactcgtgcttttcgccaagggcgcgcttgcgcgccaggatcgcaagctgggtgaagccgaacggcattatcgtgcactggtggagctcgaccccgatctcatgtcgggccaactcgaactggcgcgggtcttgttcgaaaaccgcaaggaccgtgaagcgcagggcgccttccggcaggtgcgtgaacgcctggttgtcgatggcgacagatcgacgggggtggtccgtaccgtagacgcctttctcctggcgttgagacagcggcggggctggcaaggcaatatcgccataggccccagctacagcaccaatctcaatcaatcgtccgaaagctacacctgcctgctggcgaccagcgacggcagttgcctgttcgaccggcagttgcccgatgcggtaaaggccatggggatcagtttcgaaggctcgctcaaccgcagcattccgatatcgggccatcacggtttgcgcgcccgcgcgctccttttcggcgatgtgtacccaagtgaacatgattactcgcaagccagcctcatcatgcggcttggctaccaatatcagtctgcgcgtgacacgttctcgctgtcgccatcctttgacattgggacgttaggttcatccgtcctctacgatgcctggggcgcaaatgccgagtggcagcataccctgtcccgtaaagtactgctccggcttgagggcaattatcgcgactatcgctaccggcagcgcggtttcagttcccaggatggcccgctcatcgataccagcctgaccgcgtggtatacgccggcgccgggatggacggtgtttggcggcccggatcttgccgtgaaggacactccggcggccaccaacgcctaccggcaatggggcgggcgcttggggatcggcaggacgctaggcaaaagcgccagccttcttcttctcggttcctaccggcatcgcgataaccgcgcctatagcgccgtcttcgccgccaagcggagcgatgaccagttcaatgccacggcgatcgcgcgcttccccggtttcgctttcgccgggctgacgcctgaggttgtgttccagcacaatcgcgtcgaaagcaacatcgactggctctattcctacaagcgcaccaccgccagcgtgaggctgagccgtgcgttctag

SEQ ID NO: 626 - protein, 457 aa, Sphingomonas sp. LH128
MQGQERKTESRLLEDADALDGPPTSLEIDGKTYAVGDNVDEMGQALYIAIRRRIWSEGRRFLTAYEGYTDRDPKLVLFAKGALARQDRKLGEAERHYRALVELDPDLMSGQLELARVLFENRKDREAQGAFRQVRERLVVDGDRSTGVVRTVDAFLLALRQRRGWQGNIAIGPSYSTNLNQSSESYTCLLATSDGSCLFDRQLPDAVKAMGISFEGSLNRSIPISGHHGLRARALLFGDVYPSEHDYSQASLIMRLGYQYQSARDTFSLSPSFDIGTLGSSVLYDAWGANAEWQHTLSRKVLLRLEGNYRDYRYRQRGFSSQDGPLIDTSLTAWYTPAPGWTVFGGPDLAVKDTPAATNAYRQWGGRLGIGRTLGKSASLLLLGSYRHRDNRAYSAVFAAKRSDDQFNATAIARFPGFAFAGLTPEVVFQHNRVESNIDWLYSYKRTTASVRLSRAF

SEQ ID NO: 627 - DNA, 1364 bp, Sphingomonas sp. URHD0057
atgttgactctgttgagcgccgccgcgtcgctggcggccggcccgccttcttcgaccgccgctcccgatccctgcgctggacagcagaactgccaacagctgaccgccgctcagctgttcgcggcggcggacgagcttgccggaaagggggatctggcgggcgccgcccaactattggaggcgctcacccaggatccacatccggagttacgcgccgaggcgaggtttcggctcgccgccgtccgcgaaaagctcggcgacctcaagggcgcggttcaggccctccgccagcttctggccgagcagcccaacgcgaacccggcccggctcgagctcgcgcggatcctgtcgcggctcggccagaccgaagaagcaaaaaagcaagtcgcggcggccgaagcctggggcttgccgccggaggttgagcagaatgtccgccgcttcgccagcacgctgcggacgaccaaacgccgcgggctcaccgtggaagtgaccgcgggcccggattcgaacgtcaaccgatcgacgtcgagcctgttcatcgacaccatcatcgcgccgttcgagctcgaccccgatgcgcggcgccagcccgcgcttggcttcaccggcagcctgcgcggttattcgcgcgaccggatcggcgggatcaccttgctgtccgatgccgggcttcgcgcggatctttcgaccaagccgcgcttcaacgacgtccagcttgcgctcgacagcgggccggagttccttctcggcaaggtgcaggtccgtcccgccgcgctctatgagcggcgttggttcggcggcgaccttttctcgagcggcatcggcggccagatcgaattgctcgcgccgcttgggccgaaggcccagatcagcctcaccggctcgcacctgcaccaggacgtggcaaagaattcgggacaggacggctggcggaccgccctcggagccgacctgacaagagccctgagcgccgcgaccaccgcgcgcgtcaccctgcgctacgcctcgctcaatgcccgcgtgaaccccgaaagcctgcgccaggcaggcgccgggcttctgcttgcgcaccagtcgcgctcgctaaccctgttcggggaggccgattacacccgcacgcgcgggatcgagccgcagttcctgttcggaaagacgcgccgggatcatcgttgggacctgaccgcgggcgcgatcttcaatcgcgccgccgtcgccggcttcacgccgctgatgcgcgtcacgcacagcgacagccgcgccaacatcgcgctgttcgattaccgccgcactcgcctcgatttcggcgtcacgcggagcttttagatggggacccaagcggtgcgcgaagccgagttgcgccg

SEQ ID NO: 628 - protein, 441 aa, Sphingomonas sp. URHD0057
MLTLLSAAASLAAGPPSSTAAPDPCAGQQNCQQLTAAQLFAAADELAGKGDLAGAAQLLEALTQDPHPELRAEARFRLAAVREKLGDLKGAVQALRQLLAEQPNANPARLELARILSRLGQTEEAKKQVAAAEAWGLPPEVEQNVRRFASTLRTTKRRGLTVEVTAGPDSNVNRSTSSLFIDTIIAPFELDPDARRQPALGFTGSLRGYSRDRIGGITLLSDAGLRADLSTKPRFNDVQLALDSGPEFLLGKVQVRPAALYERRWFGGDLFSSGIGGQIELLAPLGPKAQISLTGSHLHQDVAKNSGQDGWRTALGADLTRALSAATTARVTLRYASLNARVNPESLRQAGAGLLLAHQSRSLTLFGEADYTRTRGIEPQFLFGKTRRDHRWDLTAGAIFNRAAVAGFTPLMRVTHSDSRANIALFDYRRTRLDFGVTRSF

SEQ ID NO: 629 - DNA, 1461 bp, Stenotrophomonas sp. RIT309
atgcgccaccttctctttcttgtcgtcctgctgctggcctggccgctcaacgttgcccacgcgcagcaggatgacctgcgccgtgtgctcgaacagggcagcgagctgcgtcatcagcagcaggaccagcagcgcctgcgccaggccgaacacgagcgaccgaccatcaccctcgacggccagcagtaccgcgtggagcgcactgtcgacgacctcggccaggcgctctatctcgcgctgcagcaccagcaatggcaggccgcggccgccttccttgccgagtacatcgaactgcctggccacgatccgctgctgcgccactacgcgcagggtgcgctggcgcgcgtgggtggccagcacggcaaggccgcggccgaatacgaggccgtgctcgccacgcagccggacttcctgccggcgcggctggaactggcgcgtgtgtatgccgaagaccagcgcgaccgcgatgccatcgccctgttcgaggcgatcgcagccggcatcgctggcggcgaccctgcaacggcgggcgtgcgtacgcgggtggacggctacctgcaggccctgcatgcacgccagcgctggaagggtggcatcgccgccggccccgcctggagcgacaacgtcaaccgcagttcggccagccgcacctgcctgtttggtgacggcaccacctgcttcatcgaacgccggttgcccgatgcacaggcagcgttcggcctggactacgacggcagcctggaacggcgcctgccgttggccggccaccatgggctgtacctgcgcgggctggcgttcggccaggcgtggcgtgggcacagcgactacaacgagctcaatgccagcgtgcaggccggctacagctggcgcagcgcacggcataccttgctgctggcgcccagctacgattaccagggactcggcaaccacgcgctgcagggcggtgccggcatgcatggcgaatggcagttcgccgcagatgcgcgcagcctgctgaagctggaagccgactggaaacgccagcgctatcgacagcagggcgtggcgagcaactacgacggtgaactggcggcgatctatgccacctggttccgcgcgctcaacccgcgctggacggtgtttgccggggtcgacctgagtgacagcagcgccgccgatcccgccaatggctaccggcaacgcggcctgcgcctgggcgcagcgcgccagtggagcggcaccacggccacggtgttcgtgtcgctgcgtgagcgtgactacgatgcctggagcccgttgctggaggcgcgtcggcaggacagcgagcagaacctgatcgccatcgtgcgcagcgagcgcctggccgtggctgggctgatccccagcctgagcctgcgttacgcacgcatcgacagcaacgtggactggctgtacagccacgaccgcagtctgctgagcctgaaatgggaacgggcgttctga

SEQ ID NO: 630 - protein, 486 aa, Stenotrophomonas sp. RIT309
MRHLLFLVVLLLAWPLNVAHAQQDDLRRVLEQGSELRHQQQDQQRLRQAEHERPTITLDGQQYRVERTVDDLGQALYLALQHQQWQAAAAFLAEYIELPGHDPLLRHYAQGALARVGGQHGKAAAEYEAVLATQPDFLPARLELARVYAEDQRDRDAIALFEAIAAGIAGGDPATAGVRTRVDGYLQALHARQRWKGGIAAGPAWSDNVNRSSASRTCLFGDGTTCFIERRLPDAQAAFGLDYDGSLERRLPLAGHHGLYLRGLAFGQAWRGHSDYNELNASVQAGYSWRSARHTLLLAPSYDYQGLGNHALQGGAGMHGEWQFAADARSLLKLEADWKRQRYRQQGVASNYDGELAAIYATWFRALNPRWTVFAGVDLSDSSAADPANGYRQRGLRLGAARQWSGTTATVFVSLRERDYDAWSPLLEARRQDSEQNLIAIVRSERLAVAGLIPSLSLRYARIDSNVDWLYSHDRSLLSLKWERAF

SEQ ID NO: 631 - DNA, 1455 bp, Stenotrophomonas sp. SKA14
atgcgcactcccatccttctcgccgtcctgttgctggctgctgccgatgtgcgcgcccagcaggatgatcttcgccgtgtgcttgaacagggcagcgaactgcgccaccagcagcaggaccagcagcgcctgcggcaggccgagtcggagcggccgaccatcaccatcgacggccagaccctgcgcgtggagcgcaccgtggatgacctcggccaggccctttacctgtcgctgcagcatcagcaatggcaggcagcagcggccttcctcgacgagtacatcgaactgccggggcatgatccattgctgcgccactatgcacagggcgcgctggcgcgggtcagtggcgatcatcggcgcgcggcgaaggagtacgaagcgctgctggccgtgcagccggatttcctgccggcccgcctcgaactggcgcgtgtctacgccgaagaccagcgcgatcgcgatgccgtcgcgttgttcacggccatcgccgccggcatcaatagcgacgaaccggccacggccggtgtccgcgcccgcgtggacggctacctgagcgcgctgcaggcccgccagcgctggaagggcgccctggccgccggtccggcgtggagtgacaacatcaaccgcagctcggccagccgcacctgcctgttcggcgtgggcgagacctgcctgattgaacgcacgctgcccgatgcgcaacgcgccaccggcctggactacgacggcaacctcgaacggcgctgggcgttggcagggcaccatggcctgtacgtgcgcgggctggccttcggccaggcatggcgcggatacagtgcctataacgaactcaatgccagcctgcaggcgggctacagctggcgcagtgcacggcacaccgtgctgctggcgcccagctacgattaccaggcgttgggcaaccatgcgctgcagggcggcagtggcgtgcacggcgaatggcagtacgccttggatgcgcgcagcctgctcaagctggaggctgactggaagcgccagcgctaccgccagccgggtctggccagcaactacgacggtgaactggctgcgctgtatgccacctggttccgcgcgctcaatccgcgctggacggttttcgccgggctggacgtcactaccagccgtgccgacgatcaggccaacggctaccgccagcgtggtctgcgcctgggggccgcgcgccagtggccgggtaccaccgccaccgtgttcgtttcattgcgcgagcgtgactacgatgcctggagcccgctgctggaggcgcggcgcgaggacagcgaacagaacctcatcgccatcgtgcgcagcgaacggctggcggtcgcggggctggtacccagcctgagcctgcgttacgcccgcatcgacagcaatgtcggctggctgtacagccacgaccgcagcctgctcagcctgaagtgggagcgcgcgttctga

SEQ ID NO: 632 - protein, 484 aa, Stenotrophomonas sp. SKA14
MRTPILLAVLLLAAADVRAQQDDLRRVLEQGSELRHQQQDQQRLRQAESERPTITIDGQTLRVERTVDDLGQALYLSLQHQQWQAAAAFLDEYIELPGHDPLLRHYAQGALARVSGDHRRAAKEYEALLAVQPDFLPARLELARVYAEDQRDRDAVALFTAIAAGINSDEPATAGVRARVDGYLSALQARQRWKGALAAGPAWSDNINRSSASRTCLFGVGETCLIERTLPDAQRATGLDYDGNLERRWALAGHHGLYVRGLAFGQAWRGYSAYNELNASLQAGYSWRSARHTVLLAPSYDYQALGNHALQGGSGVHGEWQYALDARSLLKLEADWKRQRYRQPGLASNYDGELAALYATWFRALNPRWTVFAGLDVTTSRADDQANGYRQRGLRLGAARQWPGTTATVFVSLRERDYDAWSPLLEARREDSEQNLIAIVRSERLAVAGLVPSLSLRYARIDSNVGWLYSHDRSLLSLKWERAF

SEQ ID NO: 633 - DNA, 1158 bp, Sulfitobacter sp. CB2047
ttgcttgaggggtattcacccaagaccgagacagagaccctgcgccggatgtggatccttggggtcgcctacaaccgttcgggaaaatcacaccaagccgttgccccgctggcgcggcttgtgatcttgcggccagacgatcccacgttccggcttgaactggcgaacgcattggtgaaaagcgaccagatcgaacgggcgcgatatcaccttgaactggccaaaggtgcgggtttgtcgccctctgtccaggcaaaagtgcaggcggagcttgaccgtttggccaaaccgaaaaaatggcagggctatttccgttttgccattgtgcccgaaagcaatgccgcccgccggacctctgcagagacggtgaacctcagcggctttgtgctgcggctggacccgaattcccgcgcccaatccgccacggcgttcgagattggcacgggcgttgcgaccgtgccgcgtcttacggacgccttacgcgcccggttcgcactggatctggatgcccggcttttcgacgggcgtgcacccgatgaagtgacccttcggaccagtgcatccctgctgcatttcgccgatgaggggcgtcttgtctcggccgagatctatggatcgcagcgctggattgatgacgtggcctatgcgcatacctacggccttggtctgtcctatacgcgcaacctcggcacccgcgcccgcgccacggcggtgcttcagcgcgaacgtatcacctatgatggcagcggtgtcgacgtggaccgaacagctggtgcagcgcaattcgcttatgcggcatcgtcgcagcttgtgtttcgcgtaggtatgcgcgcggaaaaccgtgccagttcttacagccccgtcgcgggccatgcggcgggcgtcaccatcggcggcgattattcctttgccggcggtcttcgggtcgggctggatctgtcgtttgaccggaacgaatttgacggcgtgcatcccattttcggcgttgcccgcgtcgataagaaatcaagcgtcatgctgaacctgtccaaccagaactggagctacaagggatttacccaggttctgaggctcgggtttgaagagcaacgctccaccatctcgatcaacaggtttcgcaacgccactgccagcatcggcctgacacgatcgttttga

SEQ ID NO: 634 - protein, 385 aa, Sulfitobacter sp. CB2047
MLEGYSPKTETETLRRMWILGVAYNRSGKSHQAVAPLARLVILRPDDPTFRLELANALVKSDQIERARYHLELAKGAGLSPSVQAKVQAELDRLAKPKKWQGYFRFAIVPESNAARRTSAETVNLSGFVLRLDPNSRAQSATAFEIGTGVATVPRLTDALRARFALDLDARLFDGRAPDEVTLRTSASLLHFADEGRLVSAEIYGSQRWIDDVAYAHTYGLGLSYTRNLGTRARATAVLQRERITYDGSGVDVDRTAGAAQFAYAASSQLVFRVGMRAENRASSYSPVAGHAAGVTIGGDYSFAGGLRVGLDLSFDRNEFDGVHPIFGVARVDKKSSVMLNLSNQNWSYKGFTQVLRLGFEEQRSTISINRFRNATASIGLTRSF

SEQ ID NO: 635 - DNA, 1281 bp, Sulfitobacter sp. CB2047
atgaaacatcttctttttgccgccctgatgggcgttcttttggcgtgccaatcgcccggacaggcgcaggccgcgacaccacaggattatctggaacagggaaactatgacgccgcgcgggccagtctggcgcagttggtcaagggggatccgaacgggccgctgcatcaggcctatctggaaggtcaaatcctgatgcgccagaaccagcctgcggcggcggttgatctgtttcgcgatctggtacgcatcgcgcccgattatgaacccgcaagacgagagctgaccctgctgctggcctatcgcggtgatgtgaccgcggcgcgctatcatgcggaacggttggtcgcggaaaccgccgacgaacagctgcgcgccggattgcagacctttatcctgaacaacacctcgcgcaagcccggcggctttgccctgcggttcgcgctgttgccgtcgtcgaaccagacccgcggcagtgccgagcaggagatcctgattggcggggtgccgttcacgttgaaccctgcgtcgcgcgcgtcttccggggtgggactggcgattggcggcaccgcgtggcggcgctggcaatggaatgaaagatggtccggcgtgggcaccgccagtctggatgcgaaattctacgattccgcgctgaacacggaaaccacggccgtcgcacggttcgatgtcattcgtggcgggcagcgggggcggttctctttcgggccgattgccgagctgagcttttctgattcagacatcgtgcgacgccggtggggggcggagctgcgcggcgcctatcagctgcgtccgcgtgatctggtgtcgggtgcgcttcggtttgatcggcagacctatgaccaaagcccgtttcgggacgggcaccggatgcgggcttcggtctcgtaccaacatcggttgacgccgacgctcgggctatccttcggcctgtcgcagctgcgcgagacgacacagcgcgcgcatctggatcaccatgaaaccggcgtgtcgatggggatcgacaaacagtggaaatcgggcctctcgaccggagcgatactggcatacgaacaggacagatacgacggcatcttccccggcaccacgaccccgcgcgaggatgacaccaccagcctcaccttcaccgtgcagcacaacaaggtgcagatcgggaaatatgtgccgcgcatcacctatacctacacgcgggcgaaatcgaatgtggcgttgttcgactatgacagccacgacatcggggcgagtctctcgctcaagttctga

SEQ ID NO: 636 - protein, 426 aa, Sulfitobacter sp. CB2047
MKHLLFAALMGVLLACQSPGQAQAATPQDYLEQGNYDAARASLAQLVKGDPNGPLHQAYLEGQILMRQNQPAAAVDLFRDLVRIAPDYEPARRELTLLLAYRGDVTAARYHAERLVAETADEQLRAGLQTFILNNTSRKPGGFALRFALLPSSNQTRGSAEQEILIGGVPFTLNPASRASSGVGLAIGGTAWRRWQWNERWSGVGTASLDAKFYDSALNTETTAVARFDVIRGGQRGRFSFGPIAELSFSDSDIVRRRWGAELRGAYQLRPRDLVSGALRFDRQTYDQSPFRDGHRMRASVSYQHRLTPTLGLSFGLSQLRETTQRAHLDHHETGVSMGIDKQWKSGLSTGAILAYEQDRYDGIFPGTTTPREDDTTSLTFTVQHNKVQIGKYVPRITYTYTRAKSNVALFDYDSHDIGASLSLKF

SEQ ID NO: 637 - DNA, 1110 bp, Sulfitobacter sp. NAS-14.1
atgtggattctaggggtcgcctacaaccgttcgggaaaatcacaccaagccgttgccccgctggcgcggcttgtgatcttgcggccagacgatcccacgttccggcttgaactggcgaacgcattggtgaaaagcgaccagatcgaacgggcgcgatatcaccttgaactggccaagggcgcgggtttgtcgccccctgtccaggcaaaagtgcaggcggagcttgaccgtttggccaaaccgaaaaaatggcagggctatttccgttttgccattgtgcccgaaagcaatgccgcccgccggacctctgcagagacggtgaacctcagcggctttgtgctgcggctggacccgaattcgcgcgcccaatccgccacagcgttcgagattggcacgggcgtcgcgaccgtgccgcgtcttacggacgccttacgcgcccggttcgcactggatctggatgcccggcttttcgacgggcgtgcgcccgatgaagtgacccttcggaccagtgcatccctgctgcatttcgccgatgaggggcgtcttgtctcggccgagatttatggatcgcagcgctggattgatgacgcggcctatgcgcatacctatggccttggcctgtcctatacgcgcaacctcggcacccgcgcccgcgccacggcggtgcttcagcgcgaacgcatcacctatgatggcagcggtgttggcgtgaaccgaacagcaggtgctgcgcaattcgcttatgcggcatcgtcgcagcttgtgtttcgcgtaggcttgcgcgcggaaagccgtaccagttcttacagccccgtcgcgggccatgcggcgggcgtcaccatcggcggcgattattcctttgccggcggtcttcgggtcgggctggatctgtcgtttgaccggaacgaatttgacggcatgcatcccatcttcggcgttgcccgcgtcgacaagaaatcaagcgtcatgctgaacctgtccaaccagaactggagctacaagggatttacccaggttctgaggctcgggtttgaagagcaacgctccaccatctcgatcaacaggtttcgcaacgccactgccagcatcggcctcacacgatcgttttga

SEQ ID NO: 638 - protein, 369 aa, Sulfitobacter sp. NAS-14.1
MWILGVAYNRSGKSHQAVAPLARLVILRPDDPTFRLELANALVKSDQIERARYHLELAKGAGLSPPVQAKVQAELDRLAKPKKWQGYFRFAIVPESNAARRTSAETVNLSGFVLRLDPNSRAQSATAFEIGTGVATVPRLTDALRARFALDLDARLFDGRAPDEVTLRTSASLLHFADEGRLVSAEIYGSQRWIDDAAYAHTYGLGLSYTRNLGTRARATAVLQRERITYDGSGVGVNRTAGAAQFAYAASSQLVFRVGLRAESRTSSYSPVAGHAAGVTIGGDYSFAGGLRVGLDLSFDRNEFDGMHPIFGVARVDKKSSVMLNLSNQNWSYKGFTQVLRLGFEEQRSTISINRFRNATASIGLTRSF

SEQ ID NO: 639 - DNA, 1281 bp, Sulfitobacter sp. NAS-14.1
atgaaacatcttctttttgccgccctgatgggcgttcttttggcgtgccaatcgcccggacaggcgcaggccgcgacaccacaggactatctggaacagggaaactatgatgccgcgcgggccagtctggcgcagttggtcaagggggatccgaacgggccgttgcatcaggcctatctggaaggtcagatcctgatgcgccagaaccagcccgcggcggcggttgatctgtttcgcgatctggtacgcatcgcgcccgattatgaacccgccagacgcgagttgaccctgctgttggcctatcgcggtgatgtgaccgctgcgcgctatcatgcggaacggttggtcgcggaaaccgccgacgaacagctgcgcgccgggttgcagacctttatcctgaacaacacctcgcgcaagcccggcggctttgccctgcggttcgcgctgttgccgtcgtcgaaccagacccgcggcagtgccgagcaggagattctgattggcggggtgccgttcacgctgaaccctgcgtcgcgggcatcttccggggtggggctggcgattggcggcaccgcatggcggcgctggcagtggaatgaaagatggtcgggcgtgggcacggccagtctggatgcgaaattctacgattccgcgctgaacacggaaaccacggccatcacacgcttcgatgtcattcgcggcggccagcgggggcggttctctttcgggccgattgccgagctgagcttttccggttcagacatcgtgcgacgacggtggggggcggagctgcgcggcgcctatcagctgcgtccgcgtgatctggtgtcgggtgcgctgcggtttgaccggcagacctatgaccaaagcccgtttcgggacgggcaccggatgcgggcctcggtctcgtaccaacatcggttgacgccgacgctcgggctttccttcggcctgtcgcagctgcgcgaaacgacacagcgcgcgcatctggatcaccatgaaaccggcgtgtcgatggggatcgacaaacagtggaaatcgggtctctcgaccggcatgatactggcatacgaacaggacaaatacgacggcatcttccccggcaccacgaccccgcgcgaggatgacaccaccagcctcaccttcaccgtgcagcacaacaaggtgcagatcgggaaatatgtgccgcgcatcacctatacctacacgcgggcgaaatcgaatgtggcgttgttcgactatgacagccacgacatcggggcgagtctctcgctcaagttctga

SEQ ID NO: 640 - protein, 426 aa, Sulfitobacter sp. NAS-14.1
MKHLLFAALMGVLLACQSPGQAQAATPQDYLEQGNYDAARASLAQLVKGDPNGPLHQAYLEGQILMRQNQPAAAVDLFRDLVRIAPDYEPARRELTLLLAYRGDVTAARYHAERLVAETADEQLRAGLQTFILNNTSRKPGGFALRFALLPSSNQTRGSAEQEILIGGVPFTLNPASRASSGVGLAIGGTAWRRWQWNERWSGVGTASLDAKFYDSALNTETTAITRFDVIRGGQRGRFSFGPIAELSFSGSDIVRRRWGAELRGAYQLRPRDLVSGALRFDRQTYDQSPFRDGHRMRASVSYQHRLTPTLGLSFGLSQLRETTQRAHLDHHETGVSMGIDKQWKSGLSTGMILAYEQDKYDGIFPGTTTPREDDTTSLTFTVQHNKVQIGKYVPRITYTYTRAKSNVALFDYDSHDIGASLSLKF

SEQ ID NO: 641 - DNA, 1380 bp, T. equigenitalis
atggtttttgctagtttcaattatgcttatgcaatagatgaccatgtctatatcccagaacatgtcgagaaaaaaatattagaaaaccctcttaaagagcaacaaacaacggttgaagtcacttcaaaagagattgcttcaaatcctgaccttatcgttagggcaatgctatatgcacttataaacaataatatcgatgatattgttttcctgtatccatactacgaggcattgccaccagaagcaaaagagccagttgtgcactcgtgggccaggggtgtatatggagtgtattcaaacaaagtgcatgagggcatttcagatttaagagaagtcattagtcagcgacccgatattgtgcaagctagaattcaacttgcaatggcactatatttagataatcaatatattgcatccaaagatcagttccaaaaacttaagggtgagggaggtgagaattcggggctagtacaactaagcgatacatttatagaacgcattgagaataaaagcgattttgagttcacgctaaacgcaaggtatatcgtggacgataacctaaatcaggctccagaaaatccagatttggggggcggttggaaagcagaacctgcgaaatccgatagggggctggggctgagcgtgaacattgccaaacgatttgtcatagcggataatttttttgcagacattaatttaaatagcaatggaaagttttataaaaaatacgggcgacaaaatgaactaaataatcgcctaagcctaactattggacattctgaagcaaagtggagtctgtttactggaccaatcttcgggcttgatttaaacggtcaaaatcaagagcaaaaaaaattagataaatattctcggtctttggggatgagcatcaatggcaattattggcttactaaaaatattcgtagctttgcatatgtcgagcattcacgtctttaccatacgcaacgaaaacatctaaatggtcgtcaatcgtttgcatctttagggctttcatattttccaaatgcacgacacaacatttatttactggcggactttttgagatataaagctaaatttaaagacgattcgtatgttcgaaaagggcttagactggggctcataaaggagtggaatggaggtctttcaactcaattagaagcctcaaaacacctaaaaacttttgatggaattggattctttaacaaggtccagaccaatcatgattatgaattaggtgtcacgatatggcatagaaacttacacttcgcaggtcttacaccgcgtattaattacacctatcataagacaaagagcaatgtcgccctttatgcttacaacaagcataatgtatatttctcagtaagtaagagtttttaa

SEQ ID NO: 642 - DNA, 1488 bp, T. equigenitalis
atgaaatccaagttttttctttactgtactttatatgtaatcagtataaattgccaatcaattgaaactcacaacgagatttcaaatgattttaacgtccaaactaaaaactttatatccaatacaaatgaaaattcgcttttggatacatcattgatttctcaaacacaaaacgcaacctatataacaattaatggttctacttacttagttccacataccgaacatgatttaagattagctatttatcatgcgattaatgcaaatctttggggcgatttatcggaattaatagaaatatatcagacattgccaaaccatcagaaacaactggtttatatggcacaggggttgttggaacgtagccggggatatattaataaagccttaactcatatgcaaagggcatatgatattaataaggaggatttgagggttcaacttgagttagcaagactttattttgaagactacaacaatagacaatctaagaaaatatttaattcattagctcaaagttatgaattaccgaattatacgaaggggttgattaatgaataccaatcagccattaattcccagtataaatggcaaggtaatattgggttgtctattggttatgattctaatattaaccaaggtaatggtataagacagtgtgtgtttaattttatggacacctgtgttatttatagaaatttacctccccccataggttcatcatatttgggtttaaattttgacttatccaaaagatatgccttgtctgataataatgacttggaaatatcagcaagatttcagggagctaagtattctaagacagattctaaagccttatttttaacggactatagtaatttctcttcctctgcaaaaatatcttatatttatagggacagcgttaagaaagtaatgctttatccagaatttgaaatattgcacaaaaacaaatctacttattatcaatcgccaagcattaatttaaatactgaaattcaattatcacgtcgtttaaatctgaacagcaatttctcttttaaatggattaattacgagggagaaaacaaaaagtattttgaagattataaacaagttaatgtgggattagggcttgtatttgaacctagtaaaaatacatttctttatacaaattttgatttttatcgtaatctttatttaactaattattccagcagtaaagagcaatctataagaatcggagcttataaatacttatcatcaggtgtctatttgcatgcattggctatgtatcgagacactaaaaatgatgtggcaaattttctgtcatttgaaccaaggcatgataatactaaaattgcaatcttaagtataggtttgcctaaaatttcatttaaaggtgtagtgccagaattaaggtttaaatacatacaaaataaaagcaatattgatttttatatctatacgcaaagggaaattagtttaaatttaaattatagtttttaa

SEQ ID NO: 643 - protein, 459 aa, T. equigenitalis
MVFASFNYAYAIDDHVYIPEHVEKKILENPLKEQQTTVEVTSKEIASNPDLIVRAMLYALINNNIDDIVFLYPYYEALPPEAKEPVVHSWARGVYGVYSNKVHEGISDLREVISQRPDIVQARIQLAMALYLDNQYIASKDQFQKLKGEGGENSGLVQLSDTFIERIENKSDFEFTLNARYIVDDNLNQAPENPDLGGGWKAEPAKSDRGLGLSVNIAKRFVIADNFFADINLNSNGKFYKKYGRQNELNNRLSLTIGHSEAKWSLFTGPIFGLDLNGQNQEQKKLDKYSRSLGMSINGNYWLTKNIRSFAYVEHSRLYHTQRKHLNGRQSFASLGLSYFPNARHNIYLLADFLRYKAKFKDDSYVRKGLRLGLIKEWNGGLSTQLEASKHLKTFDGIGFFNKVQTNHDYELGVTIWHRNLHFAGLTPRINYTYHKTKSNVALYAYNKHNVYFSVSKSF

SEQ ID NO: 644 - protein, 495 aa, T. equigenitalis
MKSKFFLYCTLYVISINCQSIETHNEISNDFNVQTKNFISNTNENSLLDTSLISQTQNATYITINGSTYLVPHTEHDLRLAIYHAINANLWGDLSELIEIYQTLPNHQKQLVYMAQGLLERSRGYINKALTHMQRAYDINKEDLRVQLELARLYFEDYNNRQSKKIFNSLAQSYELPNYTKGLINEYQSAINSQYKWQGNIGLSIGYDSNINQGNGIRQCVFNFMDTCVIYRNLPPPIGSSYLGLNFDLSKRYALSDNNDLEISARFQGAKYSKTDSKALFLTDYSNFSSSAKISYIYRDSVKKVMLYPEFEILHKNKSTYYQSPSINLNTEIQLSRRLNLNSNFSFKWINYEGENKKYFEDYKQVNVGLGLVFEPSKNTFLYTNFDFYRNLYLTNYSSSKEQSIRIGAYKYLSSGVYLHALAMYRDTKNDVANFLSFEPRHDNTKIAILSIGLPKISFKGVVPELRFKYIQNKSNIDFYIYTQREISLNLNYSF

SEQ ID NO: 645 - DNA, 1412 bp, T. linaloolentis
atgttccatcgcttcaaagccctggggttcgtcctggcggccgctttcgtgctgcccgccgcctgggccgacgatgacgacacccgcttcctgcaggaacagacgcagcgcgccgccgagcagaaagcgcaggccgaacaggccctggccgcgccgccgggctcgctgctgtacgaaggcaaggtctatcaggtcggcaacacgctggaggaactggaaccggccctctacgtcgccatcaacaccgggcaatggacccgcctgcccgatttcatctcccgctaccgcctgctgcgcgggcaccgcccggccctggtcgcgatggccgacagcctgctggcgcgcttccacggcgactacccgaccgccgtgcagcgcatgcaggacgccaacgcccacgagcccggcgacgcccgcatccgcctcgaactggcccgcctgctgttcgaggataaccaggacaagcgcgcacgcacaggctttgcccacgcactcgaagccggcctgccgcccaatgcccggatgctggtgcaacagtatgagcaggccctggacctccgcgccggctggcacggcacggccgcgctgggctggggctacaacgacaacatcaaccaggccaacggctaccgcagttgcgaaagctacgtcccgatatggaacgtctgcgccttcgaacggatcatgcccgaggccatcggctcacagatggtgaattacgaactgtccatgcagcgccgcttcaacctgtcgggcaaccataacctgcatgtgcgcccgctcagctacggcaactactacgcgcgcaccaacccttcggacacggccagcatccgggactacagcaccaacctggcgatccttcaggcgggctaccagtatctggatgcgcgcgacaacgtcacgctgaccccgtacctggagcactactaccgcaaccgccacagcgagtacctggcccacggcctgcaactggagtggcgccattcgctgagccggcagtggcagatcggtaccagcctggatgccaagcgctacgaatacacctcgaaagggctgcgggtcggcatggactacaagcagtatcagtggggcgtgacggcgagcttctccccccagccagccaccgcgctgtacggtgggctggacctgacgcgcaagcaatacgaagtggcgcaggccagcagcaaggattgggcgctgcgcgccggcatctaccaccagtttgccggcgaggcgggcctgttcatgaacgtgctgggcatctaccgtgcgctgcgcaacgacgccttcgatggctttctcggcgcgcggcggcacgacaggcagcaggtctacatcgtcagcctgggcgccaacggctggaagatcgccgggctggtgccggaactgcgcgtgcgccacagccgcaa

SEQ ID NO: 646 - protein, 470 aa, T. linaloolentis
MFHRFKALGFVLAAAFVLPAAWADDDDTRFLQEQTQRAAEQKAQAEQALAAPPGSLLYEGKVYQVGNTLEELEPALYVAINTGQWTRLPDFISRYRLLRGHRPALVAMADSLLARFHGDYPTAVQRMQDANAHEPGDARIRLELARLLFEDNQDKRARTGFAHALEAGLPPNARMLVQQYEQALDLRAGWHGTAALGWGYNDNINQANGYRSCESYVPIWNVCAFERIMPEAIGSQMVNYELSMQRRFNLSGNHNLHVRPLSYGNYYARTNPSDTASIRDYSTNLAILQAGYQYLDARDNVTLTPYLEHYYRNRHSEYLAHGLQLEWRHSLSRQWQIGTSLDAKRYEYTSKGLRVGMDYKQYQWGVTASFSPQPATALYGGLDLTRKQYEVAQASSKDWALRAGIYHQFAGEAGLFMNVLGIYRALRNDAFDGFLGARRHDRQQVYIVSLGANGWKIAGLVPELRVRHSR

SEQ ID NO: 647 - DNA, 1497 bp, T. linaloolentis
atgtttcaacgcccgatcatggccattttcttcttggctgtcatgcttccgattcacgccctggctgacgatgacgatacccgcctgctgcttaacaagatcgatcgcagcacggcggtaagggaacgctctcacttagtggaggatacgccgcctggcatcgatccgggatccttgatcaccattggcgagacgacttatcacgtcgagaatacgctggaagatttggggccggccatttatgtttcgatgaacctgcggcagtggcacaaggtggggcagtttgtagaaaagtaccgcagtttgtccgggcatgaggaagggctcgtgctattagccgaaggaatgctggaccgagagaacagagactatcgcgcagccagcgacaagctcaatgccgcattggcggccaagccggatttcgcgcgtgccaggctggaactggcacgtgtctacttcgaggatcacaagtcgcaagaagccagggatttgttcgaccaggtttccaccagcggtattccggatgaggttcgtcccgtcatcgaaggttttcagcgggccttgcgcgaccgcgatacttggcatggttcgctggccctggggctcggctacagtagcaacgtcaaccaggctaacggcaaggtgctggtttcggaaacctgcattccggtcttcggctgcgcgatcaccaggcgtcgcatggacgagccgatcgaatcctccatgtttacctatgatttgacattgaaccgtcgttatcagatttccggccaccacaacgcattgctgcgggcgatcagctacggcaagctgcccaatgagcacaaggacacaaccgcaacgttagccagcacttactatgacgaaagcaccagcatcgtctacgcgggctacaactacatgagtgcattgaatgatttttcggtgatgccgctgttcgaacatcattacggcaaccgccacgtccgctatcaggccgtgggtttgcgtctggactggaagcacaatccaaggccggatacccaggtcggcgtcaatgcgcagcgaaagcactttcgctttcagggtcgcgaacggcagtatttcgacaattacgacgaaaatcagtttggcttctatgcttcgaatgtgctcgacgccaagacaatgatttacggcggtctgaactttacccgcaagctgtttccacaagctgttgccagcagcaaggaatacatggccaacctgggggcatacagaatgttcgatgcgggcttcaccatcaacgccaccgcgctttttcgccatatccgcaacgacgagggcagccaactcatgggcgggcgccgcgaggacgaccagcagatctacatcgtcaatctcggcatgccgcgcttcgcgttcaaaggcataacgcccaatctgtatctcaagcgcacggtcaacgacagcagcatcgactgggcttacgaataccgccagaccgaagtagtgctgaagctcgagaaaaatttttga

SEQ ID NO: 648 - protein, 498 aa, T. linaloolentis
MFQRPIMAIFFLAVMLPIHALADDDDTRLLLNKIDRSTAVRERSHLVEDTPPGIDPGSLITIGETTYHVENTLEDLGPAIYVSMNLRQWHKVGQFVEKYRSLSGHEEGLVLLAEGMLDRENRDYRAASDKLNAALAAKPDFARARLELARVYFEDHKSQEARDLFDQVSTSGIPDEVRPVIEGFQRALRDRDTWHGSLALGLGYSSNVNQANGKVLVSETCIPVFGCAITRRRMDEPIESSMFTYDLTLNRRYQISGHHNALLRAISYGKLPNEHKDTTATLASTYYDESTSIVYAGYNYMSALNDFSVMPLFEHHYGNRHVRYQAVGLRLDWKHNPRPDTQVGVNAQRKHFRFQGRERQYFDNYDENQFGFYASNVLDAKTMIYGGLNFTRKLFPQAVASSKEYMANLGAYRMFDAGFTINATALFRHIRNDEGSQLMGGRREDDQQIYIVNLGMPRFAFKGITPNLYLKRTVNDSSIDWAYEYRQTEVVLKLEKNF

SEQ ID NO: 649 - DNA, 1479 bp, V. coralliilyticus
atgaaaatcgaccgtaactttattcttggctcactgttaatggtgagcgttagctattcctttttctcttacgcggatcaggataccgatttacgtatccagcaacgcgacgcgctatcttcccgtcaaaacgaaaatgctcttattgaagaagagctggaaaaagaacgcctagctgaacagtcggcgtcaggctcagaatcgagtgtagcgaacaccgcagatgagcttggaccggcattgcatgtcgcggttcggcagcgtcaatgggcactggcagagagtctgctggaaaggtatatggcgttggcggattttgatcctatgttggtgcactacgcatcgggggcattggcacgcaatgcgcgtgattataatcaggcagaaacgcactactcggcattgcttgagatgcaggaaaactttttgcccgcagagctggagttagctcgcgtctggtttgaagacagagaaaacagcgcttctttgtcgttgtttaatgacatcctcacccgcttacctgctgataacccgagatcggcgggagtccggaatacggtagaaagttttgttagtgcactggagtatcgtgatgattggcaaggcgcgttttcctttgggccgacctacaatgacaacctcaatttgtcctcgaaacattatgaatgtctggtctatttcaccaatggtcagtgttttttagagcgcagcgcgcccaaggttaaatctgcctatggtattgactacgacgccagtttaaatcgacgtttttcgcttagtggtcatcatggcttgcagctacgcagctttgcctatggcaccaattatcagaaccacaaagaacataacgagcagacgttaaacgtgacctttggttacagctatcagactgccaaacatcagatcagtattgcaccgcagtttgaatatcgcgccttagcgaatcaggcgttgtttgcttcgggcggcttcaaggcggattggttcaccaatcttagccagacttctgctatgaaactcgaagtggaaggggaatacctcgattatcgtaatcaggcctttcgttaccaatccgactggcaatggtctgtctttggcacttactggcatcagttacccgacaaatggttagtgtttggtggtgtagactggacactgaaacaaaaccgacaggcggtgcatgagtacgatttgtggggaggtcgattgggcgtgaataaaaccttcacatcgctgaatactgacgtggccttattcgcttcgttgcggcaacgtatttatggtgacttcaatgcggtgctcggtgagcggcgtgacgatactgagcaaaattataccttagtggtgaccttgccagagctgtttgccgggtttaaaccgctcatcgaagtcaaagccaatcagaccaagagtaatgttgattgggcatacagctacaagcagcatcaatacagtataaaactagaaaaaagattctga

SEQ ID NO: 650 - protein, 492 aa, V. coralliilyticus
MKIDRNFILGSLLMVSVSYSFFSYADQDTDLRIQQRDALSSRQNENALIEEELEKERLAEQSASGSESSVANTADELGPALHVAVRQRQWALAESLLERYMALADFDPMLVHYASGALARNARDYNQAETHYSALLEMQENFLPAELELARVWFEDRENSASLSLFNDILTRLPADNPRSAGVRNTVESFVSALEYRDDWQGAFSFGPTYNDNLNLSSKHYECLVYFTNGQCFLERSAPKVKSAYGIDYDASLNRRFSLSGHHGLQLRSFAYGTNYQNHKEHNEQTLNVTFGYSYQTAKHQISIAPQFEYRALANQALFASGGFKADWFTNLSQTSAMKLEVEGEYLDYRNQAFRYQSDWQWSVFGTYWHQLPDKWLVFGGVDWTLKQNRQAVHEYDLWGGRLGVNKTFTSLNTDVALFASLRQRIYGDFNAVLGERRDDTEQNYTLVVTLPELFAGFKPLIEVKANQTKSNVDWAYSYKQHQYSIKLEKRF

SEQ ID NO: 651 - DNA, 1482 bp, V. fortis
atgaactccaacaccactccacttatacgttgcctactattgtcttgcgttttttcttcacctctttcttggtctcaagacacggatacgcagtttcgtattgaacaacgagacgccctgtcggctcaaaacaaagaacaagcaatacttgaagaagagaaccagcgcgaagcaagctccccaaaaccagcccaaactggataccagatcgacacaaacgatgtgagtcaagtcgcgaaagctcttcatcttgctgttcgttatcgtcaatgggtgcaagctaaccagttactggaaatctatcgacagtttgaacagcctgacccactgttacttaaatacgctgacggcgcaatctctcgagctaaaggttatctggaacacgcccaactcgcattcgaagacgcattagccttacaacccaattttatgcccgcgcagttagagctagcacgagtcttgtttgaaagtaaccaaaaccgagatgcgctcaatctgttcaatcaaatcaaatcaaaaataccctcacaaaatccgagagctgctggggtgattcgaaccatcgacagctttacccaagcgcttattgctcgcgacagctggaacgggtctgtggcgattggcggttcttttaatgataacttaaacagctcttctgaatcctatacctgcctagtgacatccaacacaggtcagtgtctctttgaccgtgttacgcctaaaaaagaaaaagcatatgggatcgattttgaggcgagtatcaataaacgtttctctttgtctcgacaccacggtattcatttacaaggcctaacttatggcactaactacgggaacaacagtgattacaatgaacatacctctcgaatcggctttggatacagttttcatgatcgcctcaacaaagtatcaatcggcccctcttttgaactaagtcgttacgcgaacagctctgtttatttcagctcaggagtcaagttagactggcttagaacaaccagccaaaacagtgcccttaaattcgagttcaaagccgactatcaagactacatcccaagtgtactcagctatcaaacagactggcagctggcttcgtatcttacttattggtaccaatttaatcatgacctattgttattcggtggcatagactggacaggtaaacagaacaaagaacaagtccatgcttacgagttatatggcggtaaaattggcttgaattcagatgtgattccttgggttgatctgacactttttggatcgtttagacatcgtgactaccaaggcttcaatagcattctgagcgaaacgcgtagagataaagagcaaaattacgcgatctctgcttcgctaaaagatatcaagttattcggtgttaccccttcattggtttggaatcataaaagaataaaaagcaatgttgattggctctacacctaccagcaaagtgagatcactatcaagttcactaggcgtttttaa

SEQ ID NO: 652 - protein, 493 aa, V. fortis
MNSNTTPLIRCLLLSCVFSSPLSWSQDTDTQFRIEQRDALSAQNKEQAILEEENQREASSPKPAQTGYQIDTNDVSQVAKALHLAVRYRQWVQANQLLEIYRQFEQPDPLLLKYADGAISRAKGYLEHAQLAFEDALALQPNFMPAQLELARVLFESNQNRDALNLFNQIKSKIPSQNPRAAGVIRTIDSFTQALIARDSWNGSVAIGGSFNDNLNSSSESYTCLVTSNTGQCLFDRVTPKKEKAYGIDFEASINKRFSLSRHHGIHLQGLTYGTNYGNNSDYNEHTSRIGFGYSFHDRLNKVSIGPSFELSRYANSSVYFSSGVKLDWLRTTSQNSALKFEFKADYQDYIPSVLSYQTDWQLASYLTYWYQFNHDLLLFGGIDWTGKQNKEQVHAYELYGGKIGLNSDVIPWVDLTLFGSFRHRDYQGFNSILSETRRDKEQNYAISASLKDIKLFGVTPSLVWNHKRIKSNVDWLYTYQQSEITIKFTRRF

SEQ ID NO: 653 - DNA, 917 bp, V. harveyi
atggcggttagaacctcttacaccatcgctctgacatccctgttagtgccgttgttttcttttcccgttgtagccaatgaccaagatacgaatcttcgcattcagcaaagagatgcgctatcagcacaagaaaaagaaaagcgtctcctgcaagaagaaaaagaactcgaattacagaggtcgaagcaagctcaggaacaaagctcgtcagatcaaagcaacgacaacttagggcaagcgctttacctagcagttaaaggaaagcaatggtcacaagtagaagtactattgaaccagtatcaatcttcaccctatgcagatcctttacttatccattatgcccaaggcggtctatcacgctatttaggtcgtttaagtgatgcagaggcagagtaccgatcgcttttatccttatatccgaattttcttcccgctcagttagagcttgctcgcgttttgtttgagcgtaagaaaaaccaagacgcacacacccttttctcacaaatcaaatctactctccctactgataacccaagggctgatggtgtcagacgtactctcaatgcctttatatcagcactagagcacagagatgcatggcaaggtgcgatcagttttggtccaactttcaatgacaatctcaatagcagctcagaaacctatacttgcttagtccgtcatgagacaggaaagtgtttatttgatcgagtcacaccggaaaaacagagagcagcagggttaacttttaacgcaagtgcgaataagcgcattagcttcaaaggtcatcatggtatgagtttgcaagcgctgacgtatggttctcgttacaacaatcacagtgaatacaacgagcaaacagcgaatgttagcttgggttacagctttcaagaccagcgtcatagtatcttggttgcgcc

SEQ ID NO: 654 - protein, 306 aa, V. harveyi
MAVRTSYTIALTSLLVPLFSFPVVANDQDTNLRIQQRDALSAQEKEKRLLQEEKELELQRSKQAQEQSSSDQSNDNLGQALYLAVKGKQWSQVEVLLNQYQSSPYADPLLIHYAQGGLSRYLGRLSDAEAEYRSLLSLYPNFLPAQLELARVLFERKKNQDAHTLFSQIKSTLPTDNPRADGVRRTLNAFISALEHRDAWQGAISFGPTFNDNLNSSSETYTCLVRHETGKCLFDRVTPEKQRAAGLTFNASANKRISFKGHHGMSLQALTYGSRYNNHSEYNEQTANVSLGYSFQDQRHSILVAP

SEQ ID NO: 655 - DNA, 1479 bp, V. nigripulchritudo
ttggttattcccttgcttaaatcctttttaactctttcacctatagcgcttgcgtttctattcagtgcacatacattagccgatcaagacaaaaatcagcgtctgcagcaacgggacgccctttctgcgctggaaaaagagcaggaactgttgaaagaagaacgggaaagagaagctgctttaactgtagatggtgtcacctatgaagtgagcgacacattagatgagctcggtcctgccctgcatatcgcggtaaaaacaaggcaatgggaacaagctcagggtttcctaatccgttataaagcgctggaaggatacgatcccttgctggtgcactacgctcagggtgcgcttttcagaattgagggaaaattaacagaatcggaagaagaatatcagtctcttcttgtcctcgctccggaattcatgccagccaagctagagctggctagggtacagtttgaaaaccaaaaaaaccgagattctctgaatctgttccgagagatcaaaaacaacattccacaggataacccaagagcagcaggtgttatccggaccattgatacgttcagcgaagcgctcgaagtccgtgatagctggcaaggggcttttagctttggtccttcttacagtgacaacctgaatcgcacctcggaaagctcggtatgcctggcaacgctacctaacgggcaatgctggataagtcagacgacacccgacaaagaatctggctttgggatggattatgacgccagcttaaacaaacgcttctcgctgtccggtcaccacggcgtcaaatttaacgcattggcgtatggattgctgaatgacggcaagaaaaagttcaaccaacacaccctgattaccgggctcagttacagctatcaaagcgccaagtttcagttttctatcggtccgcaagccgaatacaacaactctggcgatcgcacgctttacgtctctcccggattaaaactggatggcttctacagcatcaataataaaagcgccgcaaaagtagaactgaaagccgaatatcaggattacaaagatccggatctagaccacaacagcgactggctatggacggcttctggcacttactggtatcaattacccaaaagatggcttgtgtttggtggcatagactggaacaagaagcaaagtgaaatagaactctttgcctatgagtccctaggtgggcgactgggtgtaaaccgcgctttctttgacggctgggacatcagcgtattttcgtcggtgaaagagcgaaagcacgacggattcaacaaagttctcaacggaaaaagagaagacaaagagcaaaaccacaccttgctcgtcactgcaaaaccgctggagttttgggggctgacacccacatttacctggcaataccaaaaagtcgacagcacattggatgcgatatacagctacagccaaaatgaatacagcattaagctagagaaacgtttttaa

SEQ ID NO: 656 - protein, 492 aa, V. nigripulchritudo
MVIPLLKSFLTLSPIALAFLFSAHTLADQDKNQRLQQRDALSALEKEQELLKEEREREAALTVDGVTYEVSDTLDELGPALHIAVKTRQWEQAQGFLIRYKALEGYDPLLVHYAQGALFRIEGKLTESEEEYQSLLVLAPEFMPAKLELARVQFENQKNRDSLNLFREIKNNIPQDNPRAAGVIRTIDTFSEALEVRDSWQGAFSFGPSYSDNLNRTSESSVCLATLPNGQCWISQTTPDKESGFGMDYDASLNKRFSLSGHHGVKFNALAYGLLNDGKKKFNQHTLITGLSYSYQSAKFQFSIGPQAEYNNSGDRTLYVSPGLKLDGFYSINNKSAAKVELKAEYQDYKDPDLDHNSDWLWTASGTYWYQLPKRWLVFGGIDWNKKQSEIELFAYESLGGRLGVNRAFFDGWDISVFSSVKERKHDGFNKVLNGKREDKEQNHTLLVTAKPLEFWGLTPTFTWQYQKVDSTLDAIYSYSQNEYSIKLEKRF

SEQ ID NO: 657 - DNA, 1473 bp, V. sinaloensis
atgactcgccactacaccacttcactgcttatgttatgcagtattcccttttcaactcacctttacgcagacgcgcaagatactcgcttaagaattgagcagcaagatgccttaaccgcgcaaaaaaaagaaagcaaaatacttgaagaagaacgagaaaaggaacaagctaacacccagccagcgacccctttaaatatcgacctcaatgacccaaatcaagtcgctcaagccctctatctatccgtcaagaatcaacagtgggattctgttgaagaccttcttgacctatatcgtcaatttgaacacgccgatccgttacttgtgcattacgctcaaggtggtgtttaccgcgtcaaaggtgagctaaccaaagctgagcaagagtacacggcattacttgtctatcaagccgactttttacctgcaaaactagagctcgctcgagtcttgtttgaaaacaacaaaaactctgatgcgcaaagcctgtttgacgaaatagcgctcgcactacccgctgataacccacgttctgaaggtgtacgaaaaaccattgatgccttcactttagcgctaaacactcgagatgcttggagcggctcattcagcctaggcccttcttttaacgacaacctaaacagttcatccgaaagctacacttgcctgctgcgcgacaacgtcggtcaatgcattatcgatagagtgactccagacaaagagcgagcatacggacttgattatgaggccagcttaaacaaacgcttctccttatccgggcaccacggcattgttgtacaaggacaaacctacggcagccagtaccgtcaccatgaagattacaacgaaaacacctcacgtatcgctctcggttacagctatcacagtcaagctcatcgcatttcgctctcacctcagttcgaatacaacgggtttggaggcaagactctctatttgggttcggccgtcaaagtcgattggctcgcgacgctcaatcgccaaagtgcgataaaatttgagacaaaagcagagtatcaagactatttacctaagcaacttcactatcaatcagattggcaattttcttcccttgcgaccatttggtatcagacatcgaataagtggctactttttggaggtgtagactggacagacaaacgcaacaagcaaagcgtccacgcgtatcaggttgttggcgctcgcgttggtgtcaacaaatccattgactcactaatagatgccagtctttttgcgtctttcagagaccgacgttaccaagcgtttagcgccctcttagatgagaagcgtcatgaccaagaacagaattacaccttaattttgtcctctcccgtgttcaatttctatggcatcacaccttcattaagttggacccacaagcgagtagaaagtaacgtagactggctttacacctaccagcaaaatgaagtgtcacttaagctggtcaaaagattttaa

SEQ ID NO: 658 - protein, 490 aa, V. sinaloensis
MTRHYTTSLLMLCSIPFSTHLYADAQDTRLRIEQQDALTAQKKESKILEEEREKEQANTQPATPLNIDLNDPNQVAQALYLSVKNQQWDSVEDLLDLYRQFEHADPLLVHYAQGGVYRVKGELTKAEQEYTALLVYQADFLPAKLELARVLFENNKNSDAQSLFDEIALALPADNPRSEGVRKTIDAFTLALNTRDAWSGSFSLGPSFNDNLNSSSESYTCLLRDNVGQCIIDRVTPDKERAYGLDYEASLNKRFSLSGHHGIVVQGQTYGSQYRHHEDYNENTSRIALGYSYHSQAHRISLSPQFEYNGFGGKTLYLGSAVKVDWLATLNRQSAIKFETKAEYQDYLPKQLHYQSDWQFSSLATIWYQTSNKWLLFGGVDWTDKRNKQSVHAYQVVGARVGVNKSIDSLIDASLFASFRDRRYQAFSALLDEKRHDQEQNYTLILSSPVFNFYGITPSLSWTHKRVESNVDWLYTYQQNEVSLKLVKRF

SEQ ID NO: 659 - DNA, 1539 bp, V. splendidus
atgaagctcaaccttccacaacgattattcctaccgcttatttcttttgttgccattccaagcgcattagtcagtttgccgagcgtggcatctaaccctgatactagccttcgaattgaacaacaagatgcgctatcggcagtcgaaaaagaaaacgctattttagctgaagaaatgcaagatgaagaacagcgacaaaacgcgcagcaatcatcttctaatttaattgacccttcaatagcggatcctgagtcaacgttcagcatagatctttcggattcaaaccaagtcgcccaagccttgcacctttctgctcagcagcataattggggcttagctcagcaactactcagccattatcagctattcgataacgcagacccgctgcttattcattatgtgcgtggtggtatttatcgttcacaaggtgacctaaaacgtgcacaagaggaatacactcagttaatcacgttacaacccaactttatgccagcgcaattagaactagcacgcgttctattcgaaaaccacaacaactcagagtcattagaattattcaaacaaattgaagcttcactcccatctaacaaccctcgaactcaaggtattcaacgaaccatagatgtattttcaagtgcgcttaaagctcgtgatgactggggcggttccattagtttcgggccatcgtttaatgacaatctaaacagctcttccgaaagctacacatgtttagttcatagcgatattgggcaatgcatcatcgatagagtcaccccaaaaaagcaacaggcttttggtatcgattatgaagcgagcttaaataaacgaacctcactcactggtcatcatggcgtttcttttagtgggcttacctacggcactcgttattcaggtcatgacgaatatgatgagcaaaccgtaaaagcgagctttgggtacagttatcagagccaaagagatcgcgtgtccttcgcaccacaatttgagttcaatacgtttgcaggaaaaagcctgtatttaagttctggaatcaaactggattggttcaaaaccgtaaacaaacaaagtgcatttaaattcgaaaccaaagctgattatcaaaactatcaaccaggaaaactggattatcagtctgattggcaattctcaaccttgttcacttattggtatcaattacctgaaaaatggttgttatttggaggcttggactggacagataaacgaaatgatcaacaagttcatgcttatactttgtctggcgttcgacttggggttaataaaaacgtcagcccatggttagatatcagtctatttgcttctttgagagatcgccgatatcaagatttcagtgctttacttggagataagcgacatgacagagaacaaaattacaccttagtcattcactcaccaagtattgagtatttaggcgtgtctcccacccttagctggactcataaacgagtgaaaagcaatattgactggctttatacttaccaacagaatgaaatcggcttaaagctcactaaacgcttctag

SEQ ID NO: 660 - protein, 512 aa, V. splendidus
MKLNLPQRLFLPLISFVAIPSALVSLPSVASNPDTSLRIEQQDALSAVEKENAILAEEMQDEEQRQNAQQSSSNLIDPSIADPESTFSIDLSDSNQVAQALHLSAQQHNWGLAQQLLSHYQLFDNADPLLIHYVRGGIYRSQGDLKRAQEEYTQLITLQPNFMPAQLELARVLFENHNNSESLELFKQIEASLPSNNPRTQGIQRTIDVFSSALKARDDWGGSISFGPSFNDNLNSSSESYTCLVHSDIGQCIIDRVTPKKQQAFGIDYEASLNKRTSLTGHHGVSFSGLTYGTRYSGHDEYDEQTVKASFGYSYQSQRDRVSFAPQFEFNTFAGKSLYLSSGIKLDWFKTVNKQSAFKFETKADYQNYQPGKLDYQSDWQFSTLFTYWYQLPEKWLLFGGLDWTDKRNDQQVHAYTLSGVRLGVNKNVSPWLDISLFASLRDRRYQDFSALLGDKRHDREQNYTLVIHSPSIEYLGVSPTLSWTHKRVKSNIDWLYTYQQNEIGLKLTKRF

SEQ ID NO: 661 - DNA, 1176 bp, Vibrio cholerae MZO-3
atgatttttatggttgttaatataatgaaaggaaaatgtatacttattgttttcactcttgttcttttggcttgtcaacctgtggtatgcaaagagaagaatgagcttgatgatacagtacttaatgctcaaagatatcttgttgagaataatattaaggccgcactttctattctggaaaatgctatattaaaatatcctaaaaataacgtgctaagacttcagtttgctattgctttatataaaaataaatcttatgaggattctcttaaccaattgtttaaattaaagtctatggaggaggactctcaggttttagaaaaaatagatatgtatatagataggattaataatattaaaagaacaacatacgattttcatttttcatacgaagtagatgataatgtttttaattatcctaggggggaatttaatggttggcatttttctgaacccaaaaaggataattatattaattattttttttcattggaaaatattaatcctatttttaaaaatgttagttttaaaaacaatcttttaatttatggaagagagtacaaagatatcaaagagaaaaattatgtttcatttaaattaaaatcaggtttacactatgcagattttaatattgcttactcgatacaacctttagttgagtttaaagatagttaccaagaaaatatttttttcttaggtgcttatgtatacttttcaactgtttttgatagaaataaaaagtttaatatccatatggagaaaaaatgggatatcgagcatcatgataattccaatctgttaaattttggttatttgcaaaatatatcgccatggagttatatttatcttgattttggtaggagttattttgttggtaataatgtaataggttctaatgattattttagattggggtggagttatgattgggatattggaatatctacacttatgagttgtggcttttcatatagaaaatctaatactatagatatttttaaagttaaaccaaaatcatatgaatatgaacctgagcttgttgtatggtatcgcccattatccttgtatggcatagtgccaaaaataaaagtttcctttataaaaagtaagagtaatcatcctgcgtttaacttttcaaaaagaaatatttctctttttattacaaaaacattttaa

SEQ ID NO: 662 - protein, 388 aa, Vibrio cholerae MZO-3
MVVNIMKGKCILIVFTLVLLACQPVVCKEKNELDDTVLNAQRYLVENNIKAALSILENAILKYPKNNVLRLQFAIALYKNKSYEDSLNQLFKLKSMEEDSQVLEKIDMYIDRINNIKRTTYDFHFSYEVDDNVFNYPRGEFNGWHFSEPKKDNYINYFFSLENINPIFKNVSFKNNLLIYGREYKDIKEKNYVSFKLKSGLHYADFNIAYSIQPLVEFKDSYQENIFFLGAYVYFSTVFDRNKKFNIHMEKKWDIEHHDNSNLLNFGYLQNISPWSYIYLDFGRSYFVGNNVIGSNDYFRLGWSYDWDIGISTLMSCGFSYRKSNTIDIFKVKPKSYEYEPELVVWYRPLSLYGIVPKIKVSFIKSKSNHPAFNFSKRNISLFITKTF

SEQ ID NO: 663 - DNA, 1479 bp, Vibrio sp. B183
atgaaaatcgaccgtaactttattcttggctcactgttaatggtgagcgttagctattcctctttctcttacgcggatcaggataccgatttgcgtatccagcaacgtgacgcgttatcctcccgtcagaacgaaaatgctcttattgaagaagagttggaaaaagaacgcctagccgagcaatcggcgtcaggctcagaatcgatcgtagcgaataccgcagatgagcttggaccggcattgcatgtcgcggttcggcagcgtcaatgggcactggcagagagtctgctggaaaggtatatggcgttggcggattttgatcctatgttggtgcactacgcatcgggggcattggcacgcaatgcgcgtgattatgatcgggcagaaacgcactacgcgacattgcttgagatgcaggaaaactttttacccgcagagttagagttagctcgcgtctggtttgaagacagagaaaacagcgcctctatatcattatttcatgacatcctcagtcgcttacctgctgataacccgagagcggcgggagtccggaatactgtagaaagttttgttagtgcactggagtatcgtgatgagtggcaaggtgcattttcatttgggccgacttacaacgacaacctgaatttgtcctcgaaacactatgaatgtctggtctatttcaccaatggtcagtgctttttagagcgtagcgcgcccaaggttaaatctgcctatggtattgactacgacgccagtttaaatcgacgcttttcgcttagtggtcatcatggcttgcagctacgcagctttgcctatggcaccaattaccagaaccgcaaagaacataacgagcagacgttaaacgtgacctttggttacagctatcagaccgctaaacatcagctcagtattgcgccgcagtttgaatatcgcgccttagcgaatcaggcgttgtttgcttcgggcggcttcaaggcggattggtttgccaatcttagccagacttctgctatgaaactcgaagtggaaggggaatatctcgattatcgtaatcagacctttcgctatcaatccgactggcaatggtctgtctttggcacttactggcatcagttacccgacaaatggttagtgtttggtggtgtagactggacactgaaacaaaaccgacaggcggtgcatgagtacgatttgtggggaggtcgattgggcgtgaataaaaccttcacatcgctgaatactgacgtgaccttattcgcttcgttgcggcaacgtatttatggtgacttcaatgcggtgctcggtgagcggcgtgatgatactgagcaaaattataccttagtggtgactctgccagagctgtttgccgggtttaaaccgctcatcgaagtcaaagccaatcagaccaagagtaatgttgattgggcatacagctacaagcagcatcaatacagcgtaaaactagaaaaaagattctga

SEQ ID NO: 664 - protein, 492 aa, Vibrio sp. B183
MKIDRNFILGSLLMVSVSYSSFSYADQDTDLRIQQRDALSSRQNENALIEEELEKERLAEQSASGSESIVANTADELGPALHVAVRQRQWALAESLLERYMALADFDPMLVHYASGALARNARDYDRAETHYATLLEMQENFLPAELELARVWFEDRENSASISLFHDILSRLPADNPRAAGVRNTVESFVSALEYRDEWQGAFSFGPTYNDNLNLSSKHYECLVYFTNGQCFLERSAPKVKSAYGIDYDASLNRRFSLSGHHGLQLRSFAYGTNYQNRKEHNEQTLNVTFGYSYQTAKHQLSIAPQFEYRALANQALFASGGFKADWFANLSQTSAMKLEVEGEYLDYRNQTFRYQSDWQWSVFGTYWHQLPDKWLVFGGVDWTLKQNRQAVHEYDLWGGRLGVNKTFTSLNTDVTLFASLRQRIYGDFNAVLGERRDDTEQNYTLVVTLPELFAGFKPLIEVKANQTKSNVDWAYSYKQHQYSVKLEKRF

SEQ ID NO: 665 - DNA, 1479 bp, Vibrio sp. HENC-01
atggcggttagaacctcttacaccatcgctctgacatccctgttagtgccgttgttttcttttcccgttgtagccaatgaccaagatacgaatcttcgcattcagcaaagagatgcgctatcagcacaagaaaaagaaaagcgtctcctgcaagaagaaaaagaactcgaattacagaggtcgaagcaagctcaggaacaaagctcgtcagatcaaagcaacgacaacttagggcaagcgctttacctagcagttaaaggaaagcaatggtcacaagtagaagtactattgaaccagtatcaatcttcaccctatgcagatcctttacttatccattatgcccaaggcggtctatcacgctatttaggtcgtttaagtgatgcagaggcagagtaccgatcgcttttatccttatatccgaattttcttcccgctcagttagagcttgctcgcgttttgtttgagcgtaagaaaaaccaagacgcacacacccttttctcacaaatcaaatctactctccctactgataacccaagggctgatggtgtcagacgtactctcgatgcttttatatcagcactagaacacagagatgcatggcaaggtgcgatcagttttggtccaactttcaatgacaatctcaatagcagctcagaaacctatacttgcttagtccgtcatgagacaggaaagtgtttatttgatcgagtcacaccggaaaaacagagagcagcagggttaacttttaacgcaagtgcgaataagcgcattagcttcaaaggtcatcatggtatgagtttgcaagcgctgacgtatggttctcgttacaacaatcacagtgaatacaacgagcaaacagcgaatgttagcttgggttacagctttcaagaccagcgtcatagtatcttggttgcgtcgttgatcgagtacagcacatacgcggataagagtttgtattggtcaacaggtctaaagttgaatggattccatagcttagactcgaaaagcgcattgagatgggaactaaaaggcgaataccaatattaccgtccaacaaagctcgactatcaatcagattggcaatggaatgcaagcatcaactattggcaccagttgccacaacaatggctcgcattcggtggcatagactggacgcataaacaaaatgatcaagatgtacatgcttaccagctctatggtggtcgaatcggagtcgtgaaaagcgtcgaaggttggcttgacgctaacctgtttgcatcactgcgagaaaggcaatacgagggatataacgccctactcgatgcaaagagaagagacacagagcaaaactatactgtcacattttcctctccaaagttggttttttggacgttgacacccattctagagtggactcataaacgggtaaacagcaacgttgattggctgtacacctatcagcagaatgaggtgagcgtaaaatttgaaaagcgtttttga

SEQ ID NO: 666 - protein, 492 aa, Vibrio sp. HENC-01
MAVRTSYTIALTSLLVPLFSFPVVANDQDTNLRIQQRDALSAQEKEKRLLQEEKELELQRSKQAQEQSSSDQSNDNLGQALYLAVKGKQWSQVEVLLNQYQSSPYADPLLIHYAQGGLSRYLGRLSDAEAEYRSLLSLYPNFLPAQLELARVLFERKKNQDAHTLFSQIKSTLPTDNPRADGVRRTLDAFISALEHRDAWQGAISFGPTFNDNLNSSSETYTCLVRHETGKCLFDRVTPEKQRAAGLTFNASANKRISFKGHHGMSLQALTYGSRYNNHSEYNEQTANVSLGYSFQDQRHSILVASLIEYSTYADKSLYWSTGLKLNGFHSLDSKSALRWELKGEYQYYRPTKLDYQSDWQWNASINYWHQLPQQWLAFGGIDWTHKQNDQDVHAYQLYGGRIGVVKSVEGWLDANLFASLRERQYEGYNALLDAKRRDTEQNYTVTFSSPKLVFWTLTPILEWTHKRVNSNVDWLYTYQQNEVSVKFEKRF

SEQ ID NO: 667 - DNA, 687 bp, Vibrio sp. HENC-02
atgagtttgcaagcgctgacgtatggttctcgttacaacaatcacagtgaatacaacgagcaaacagcgaatgttagctttggttatagctttcaagaccagcgtcatagtatcttggttgcgccgttgatcgagtacagctcatacgcggataagagtttgtattggtcaacaggtctaaagttgaatggattccatagcttagactcgaaaagcgcattgagatgggaactaaaaggcgaataccaagattaccgtccaacaaagctcgactatcaatcagattggcaatggaatgcaagcatcaactattggcaccagttgccacaacaatggctcgcattcggtggcatagactggacgcataaacaaaatgatcaagatgtacatgcttaccagctctatggtggtcgaatcggagtcgtgaaaagcgtcgaaggttggcttgacgctaacctgtttgcatcactgcgagaaaggcaatacgagggatataacgccctactcgatgcaaagagaagagacacagagcaaaactatactgtcacattttcctctccaaagttggttttttggacgttgacacccattctagagtggactcataaacgggtaaacagcaacgttgattggctgtacacctatcagcaaaatgaggtgagcgtaaaatttgaaaagcgtttttga

SEQ ID NO: 668 - protein, 228 aa, Vibrio sp. HENC-02
MSLQALTYGSRYNNHSEYNEQTANVSFGYSFQDQRHSILVAPLIEYSSYADKSLYWSTGLKLNGFHSLDSKSALRWELKGEYQDYRPTKLDYQSDWQWNASINYWHQLPQQWLAFGGIDWTHKQNDQDVHAYQLYGGRIGVVKSVEGWLDANLFASLRERQYEGYNALLDAKRRDTEQNYTVTFSSPKLVFWTLTPILEWTHKRVNSNVDWLYTYQQNEVSVKFEKRF

SEQ ID NO: 669 - DNA, 1473 bp, X. bovienii
atgtctgacaatataacaaccccaatattattaacggcactgatggccttatgtctctccctgccggtttatgctgatgaagataccaaccgcaaaatctggcaggaggcgcagcacaatcaacaagaaaatgaagctgatctgataacgccagagcctatttttattgaggatggtgcttcatcgatagtcattaacggacagacatttcaggtagaaaacaacctcgataacatcggtcaggcactataccttgccactaaccatcgacagtggccggacgtcagacgttttctgacggcttatcaaaaactatccgggcatgatgtcatgctggcctcttttgcccagggcggcctggcgcgttttgaaggcgatttggatctcgccgcctatcattatcaaaagctcctgaaccaacaacccgacttcacacgcatcaagctggaactggcccgtgtttattttgaaaatcataaaaatcgggaagccgagcaactgtttgtaggattgagtgaacagaacctcttaccggaaacggtcttgaaaaatatcaacagctatttgaaagcgatagcattgagaagtgactggcgtggctctttttcggtaggttatgcctataacgataatgtcaatatgtctccggatcaggaatcaacctgccttgaatataaccctgatgggagttgccaggaggaacgccggataccaaaagccattaaaaagtgggggatgtcttatgacgccacattaagccgacgttaccaactttccggtcatcacggcatttttggacgtggcctgatttatggcgaaaactaccgtgattaccacgctgaaaatgaaaataccgtcctgctggtcagcggatacaactacaaaagcagaaatcacgatttctcttttggccccctgtttgaatataaacatcgggcgggtgatacctattaccgcgccacaggtgtcaaaacggaatggagacaaacattcagccctaaaacagctctcaatatcgaactggagcataaacaactgcggcatcagcagcgttaccactggaaaaatggcgacctctcctcatcctatctcactctttcccatgccatcagcaaagaatttgtcatatttggtggcggtgactgggtctatcggaacaatccgcaaccggcggatcgctatcaacaatggggaattcgggcaggcgtatccggacagatctaccccggtattaatggctcactgtctgccacactgcgagagcggcgctttggtgcttacagcccgatactgctcgccagacgtcaggatgatgaacagatctatactgccgtcattaaagtccctgccgctgaaatattgggtatgaccccctctatcactttccgccatcgacgcaatcacagcagtgtgaattggctgtacaactataacaaaaacgaagtactgctgaggctggaaaaatatttttaa

SEQ ID NO: 670 - protein, 490 aa, X. bovienii
MSDNITTPILLTALMALCLSLPVYADEDTNRKIWQEAQHNQQENEADLITPEPIFIEDGASSIVINGQTFQVENNLDNIGQALYLATNHRQWPDVRRFLTAYQKLSGHDVMLASFAQGGLARFEGDLDLAAYHYQKLLNQQPDFTRIKLELARVYFENHKNREAEQLFVGLSEQNLLPETVLKNINSYLKAIALRSDWRGSFSVGYAYNDNVNMSPDQESTCLEYNPDGSCQEERRIPKAIKKWGMSYDATLSRRYQLSGHHGIFGRGLIYGENYRDYHAENENTVLLVSGYNYKSRNHDFSFGPLFEYKHRAGDTYYRATGVKTEWRQTFSPKTALNIELEHKQLRHQQRYHWKNGDLSSSYLTLSHAISKEFVIFGGGDWVYRNNPQPADRYQQWGIRAGVSGQIYPGINGSLSATLRERRFGAYSPILLARRQDDEQIYTAVIKVPAAEILGMTPSITFRHRRNHSSVNWLYNYNKNEVLLRLEKYF

SEQ ID NO: 671 - DNA, 1476 bp, X. cabanillasii
atgtctgacaatagaaaaacgccaatattattaacgtcattgatagccttatgcttctctttacccatttatgctgatgacgaagatacttcacgcaaaatctggcaagaagcacagcataaccaacaggagaaagaaactaatctgattacgccagatcctgttttcattgaaaataactcatcattgattgtcattaatgggcaaccttttcaggtcgaaaataatattaatgatatcggtcaggcactcttcctcgccgttaaccatcaacaatggtcagacgtcaggcgttttctggcagcatacctgaaattgccggaacacgatgttatgttggtgaattttgcccaaggtggactggcccgccttgacggaaatttagatctcgctgcctatcattatcaacaaatcctgaaccaacaacccgattttcctcgcatcaagctggaattggcccgtgcctattttgaggatcataagaatcgggaagcagaggaattgtttactgaattgtatgaagcaaaaaagctaccagaagtagtgctgaaaaatatcaatagctatctggaagcaataagcttaagaaatagctggcgcggctctttctctgctggttatgcctataacgacaatgtgaatatgtcctccaatcagaggggaacctgcctgtacaatatctctgccgataaatgtctcaaacgacaagttccaaaagctattaaagcatggggaatgtcttatgacgcaacattaagccgacgctaccaacttatcggccatcacggtatttttggccgcggcctgatttatggtgaaaactaccgtgactaccatgatgagaacgaaaacactttccagctaatcggtggctacagttataaaaacaggaagcacgatatctcttttggccctgtgtttgaatataaacaacatgctggtgatactttttatcgtgccacaggtctcaaaactgagtggagatggggcattacttctcaaactgcccttaatgttgaacttgaacacaaacaattgcgccatcaacggcattatcgcaggaaagacggtgaactcacctcttcttacctcactttatcccacgccatcaacaaagaatttatcctgtttggcggtggtgactgggtttatcgggataacgacctgtatcccgtagaccgttatcaacaatggggtgcccgtgcggggattgccgggcaaatctaccccggcatcaatggatcactgtttgccacactgcgggatcggcgctttggtgcttacagcccgatgcttagagccagacgtcaggatacggagcagatttataccgccgttatcaaagttcctgccgctgaaatattgggcatgaccccctctgtgactttccgccaccgacgcaatcatagcaatgtagattggctatacagctttaacaaaaacgaagtgctgatccggctggaaaagtatttttaa

SEQ ID NO: 672 - protein, 491 aa, X. cabanillasii
MSDNRKTPILLTSLIALCFSLPIYADDEDTSRKIWQEAQHNQQEKETNLITPDPVFIENNSSLIVINGQPFQVENNINDIGQALFLAVNHQQWSDVRRFLAAYLKLPEHDVMLVNFAQGGLARLDGNLDLAAYHYQQILNQQPDFPRIKLELARAYFEDHKNREAEELFTELYEAKKLPEVVLKNINSYLEAISLRNSWRGSFSAGYAYNDNVNMSSNQRGTCLYNISADKCLKRQVPKAIKAWGMSYDATLSRRYQLIGHHGIFGRGLIYGENYRDYHDENENTFQLIGGYSYKNRKHDISFGPVFEYKQHAGDTFYRATGLKTEWRWGITSQTALNVELEHKQLRHQRHYRRKDGELTSSYLTLSHAINKEFILFGGGDWVYRDNDLYPVDRYQQWGARAGIAGQIYPGINGSLFATLRDRRFGAYSPMLRARRQDTEQIYTAVIKVPAAEILGMTPSVTFRHRRNHSNVDWLYSFNKNEVLIRLEKYF

SEQ ID NO: 673 - DNA, 1383 bp, X. cabanillasii
atgactggcaagagaaacgtggctgtattacttgcgtcactactgacatcactccttttttcaacaggctacgccaatgatatatcaaatgagatttcaccaaagattcatgggcaagaatttaaggttaaaaacaatcttaaggatatcggtcaagcactgtaccttgccattaattatcagcaatggtcagatgtaagacgctttttgtcggtttatcaaaaattgccggggcatgatgttatgctggtcaattttgccctgggtgggctggcacgtcgtgaggggaatttaactctcgcagcttccctctatcaaaaaatcctgcgtcaaaaaccgaatttcacccgcatcaaattggaattggcccgtgtctattttgaagatcataaaaatcgggaagccaaacagttaatggatgaattaagtaaacagcatcaattacccgcaaccgttttgaagaacatcgacggttatataaaagcaatcacccaaagaaaccgctggcgcagttcgttttcactcagttatatctataacgataatataaatatgtctccaaatatgaaaccggactgtctgcttattttaaaaggagaatgtaaaattgaacgggaaataccaaaagcgatcaaagaatggggaagcgcttatcatgttacattaagccggcgttaccagcttgttggccaccacggcatttttggtcgcggaatgattgatggtgaaatctatcctcatttccataacggaaacgaaaacacgtttttgctgatcagtggctacaattttaaaagcaggaataatgacttatcctttgctcctttgtttgaatataaacaacaagccggaataaccgaataccatgctgtcgctgccaaaatagaatggcaatgggctatctctgatcaaaccttcctcagcgctgaatttgaacataagcgattcagttatcagcctctttatcattggaaaaatggcgaactttcctcatcttatttcaatctctcccatgctatcggcaacgattttattctgtttggcggcactggctggagctatcgaaacaatcaacaaccggcagctcgctatcaacaatggggagttactgcggggatagccgggccactttattccggcattgatggctcgctgtttgccacactgaaaacgcaacgttttggcgcctacagcgcattactgggtgccaaacgtcaagataatgaacagatctataccgcttccgttaaatttcctgccagcaaaatctgggggatgacaccttctgtcactttccgccacttgcacaatcgtagcaatgtaaactggcaatacagttacgataaaaacgaaatacaaatacagctagaaaaatatttttag

SEQ ID NO: 674 - protein, 460 aa, X. cabanillasii
MTGKRNVAVLLASLLTSLLFSTGYANDISNEISPKIHGQEFKVKNNLKDIGQALYLAINYQQWSDVRRFLSVYQKLPGHDVMLVNFALGGLARREGNLTLAASLYQKILRQKPNFTRIKLELARVYFEDHKNREAKQLMDELSKQHQLPATVLKNIDGYIKAITQRNRWRSSFSLSYIYNDNINMSPNMKPDCLLILKGECKIEREIPKAIKEWGSAYHVTLSRRYQLVGHHGIFGRGMIDGEIYPHFHNGNENTFLLISGYNFKSRNNDLSFAPLFEYKQQAGITEYHAVAAKIEWQWAISDQTFLSAEFEHKRFSYQPLYHWKNGELSSSYFNLSHAIGNDFILFGGTGWSYRNNQQPAARYQQWGVTAGIAGPLYSGIDGSLFATLKTQRFGAYSALLGAKRQDNEQIYTASVKFPASKIWGMTPSVTFRHLHNRSNVNWQYSYDKNEIQIQLEKYF

SEQ ID NO: 675 - DNA, 1473 bp, X. doucetiae
atgtctgacaatcgaacaccctctatattattcaccgcagtggtggccttatgcctgtccctgccaggctatgccgatgacgataccagccaaaaaatctggcaggaggcacaacataatcaacgagaaaatgaagccagcctgattacacccgaccccgtttttactgagaatggttcatcgttaattgtgattaacgggcaaacctttcaggtagaaaataatattaatgatatcggccaggcattatttcttgccattaaccatcaacaatggccggatgtcaggcgcttcctcacggcttatctaaaattgccggagcatgatgtgatgctggttaattttgcccaaggtggactggcgcgtttagacggggacttggatctcgccgccgatcattaccaacaaatcctgcatcaacagcccgattttccccgtatcacactggaactggcccgggtctattttgaggatcataaaaaccgggaagccgaacaactgtttaccggattgtatcaggcgcaaaacctcccggaagccgtactgaaaaatattaacagctatctggaagcgatagcgctgagaaacagttggcgcggctctttctcggccggttacgcctataacgataacgtcaatatgtctcctgatcaggggccagtctgtaggcaatacgtgggagataaatgtaatattgaacagcgaataccaaaagccgtcaaagcctggggcatgtcttatgacgccacattaagccgacgctatcagcttaccggtcatcatggcatttttggccgtagcctgatttatggcgaaaattaccgtgattaccacgatgaaaacgaaaatacgttgctgctggtgggtggctataactataaaagcaagcgtcatgatttctcgtttggcccgttgtttgaatataaacaacgggcagacgatgccggttaccgtgccaccggggctaaaaccgaatggcgatgggccttcactgccaaaaccgccctgaatgtggagcttgagcataaacagctacgttaccaacaaccgttccgccggaaagatggcagcttttcctcaacctatctcaccctattccattccatcaataaagacgttgttctgtttggcggcggcgactgggtttaccgcgacaacaagcagtatgccgtggatcgctatcagcaatggggtgttcgggcggggattgccggacagatctatcccggcattaacggttccctgtttgccacactgaaacagcgccattttggggcaagtcacccaatgacaaagacccggcgtcaggataacgaacagatttacagcgcggtgattaaagtgccggccgcagaaatttggggcatgacaccgtctgtgacgttccgccatcggcgcaatcacagcaacgtggcctggctgtacagctataacaaaaacgaaatccttatcaggctggaaaagtatttttaa

SEQ ID NO: 676 - protein, 490 aa, X. doucetiae
MSDNRTPSILFTAVVALCLSLPGYADDDTSQKIWQEAQHNQRENEASLITPDPVFTENGSSLIVINGQTFQVENNINDIGQALFLAINHQQWPDVRRFLTAYLKLPEHDVMLVNFAQGGLARLDGDLDLAADHYQQILHQQPDFPRITLELARVYFEDHKNREAEQLFTGLYQAQNLPEAVLKNINSYLEAIALRNSWRGSFSAGYAYNDNVNMSPDQGPVCRQYVGDKCNIEQRIPKAVKAWGMSYDATLSRRYQLTGHHGIFGRSLIYGENYRDYHDENENTLLLVGGYNYKSKRHDFSFGPLFEYKQRADDAGYRATGAKTEWRWAFTAKTALNVELEHKQLRYQQPFRRKDGSFSSTYLTLFHSINKDVVLFGGGDWVYRDNKQYAVDRYQQWGVRAGIAGQIYPGINGSLFATLKQRHFGASHPMTKTRRQDNEQIYSAVIKVPAAEIWGMTPSVTFRHRRNHSNVAWLYSYNKNEILIRLEKYF

SEQ ID NO: 677 - DNA, 1434 bp, X. doucetiae
atgtctgacaaaaaagaaggatctggaaagagaaaatatctattattacttatattcttgttgacttcatttctctcaccagcaatttgtgccaatgaagatcatttgatggcaccaaaccccctttctgccaaacatgattccttattaaatattatccgtagacaaaaaattaaggttagcaacaatctcaacgatatcggtcaggcactgtactttgccattaattatcggcagtggcgagacgtcagacgtcttttgctggcttatcaaaagctccctggttacgatccgtttctcatcgattttgctcagggccggctagcctatcgtgaaggaaatttagcactcgctacctcttattatcaaaagatcttgcgccaaaaaccgaatttcacgcgcatcaaactggaactggctcgtgtttattttgaagatcaaaaaaaccgtgaatccaagcagttatttgaaggaataagccaacagcagcaattacccgaaatggtcttaaataatatcggcagttatctggcagaaatagccctaagaaatggctggcaaagttcactttcattcggctatacctatgacgataatatcaatatgtcgccaaatcagaaacccatctgcctggtttccgagaagggaaagtgcatcattaaacggcaagtgccgaaacctgtcacggcatggggtggaacttataacgcaacattaaaccgacgttaccaactggttggtcatcacggcattttcggtcgtggtctgatttatggagaaaattattcccattaccataacgaaaacgaaaacaggttcctgctggtcagtggctacaactataaaaaccggttccatgatttctcttttggccccctctttgaatatcaacagagtgcagggaaaaccgaataccatgccatcggtgccaaaatggaatggcaatgggctattaccaagcaaacctccctcaatgtcgaactggaacataagaaattgagttatccaccgatttaccgcgggaaagacaacgtgctttcctcatcctatttcagcctgtctcatgccatcagtgaaaaattaatattgtttggcggcggtaattggcgctatggaaactatcaagatcccgcagattgctatcagcaatggggggtaagtgcaggaatagcggggcagctctatccccgcattaatggttctctgtctttcactttaaggaaacagcgcttcagcgcctacagcgcattattgggtgccagacgtcaagataatgaacagatctatacggctgccattaaatttcctgctgccaaggtattgggcatgacaccctctttaactttccgccatcactacaatcacagtaacgtgaactggttgtacagttatgataaaaacgaaatccagatacagttagaaaaatatttctaa

SEQ ID NO: 678 - protein, 477 aa, X. doucetiae
MSDKKEGSGKRKYLLLLIFLLTSFLSPAICANEDHLMAPNPLSAKHDSLLNIIRRQKIKVSNNLNDIGQALYFAINYRQWRDVRRLLLAYQKLPGYDPFLIDFAQGRLAYREGNLALATSYYQKILRQKPNFTRIKLELARVYFEDQKNRESKQLFEGISQQQQLPEMVLNNIGSYLAEIALRNGWQSSLSFGYTYDDNINMSPNQKPICLVSEKGKCIIKRQVPKPVTAWGGTYNATLNRRYQLVGHHGIFGRGLIYGENYSHYHNENENRFLLVSGYNYKNRFHDFSFGPLFEYQQSAGKTEYHAIGAKMEWQWAITKQTSLNVELEHKKLSYPPIYRGKDNVLSSSYFSLSHAISEKLILFGGGNWRYGNYQDPADCYQQWGVSAGIAGQLYPRINGSLSFTLRKQRFSAYSALLGARRQDNEQIYTAAIKFPAAKVLGMTPSLTFRHHYNHSNVNWLYSYDKNEIQIQLEKYF

SEQ ID NO: 679 - DNA, 1476 bp, X. nematophila
atgtctgacaatagaacaacgccaatattagcagcggcattgatagctctgtgcctttccctgtccgtttatgccgatgaggatacttcccgtaatatctggctggacgctcaacataaccaacaagaaaatgaaactaacctaattacgccagatcccatttttatgggaagtaactcgtcatttattgtgattaacggacagacttttcaggttggcaacaatattaatgatctcgggcaggctttattccttgccattaaccaccaacaatggccggatgtcaggcgctttcttgcggcttaccaaaaactgccggagcatgatgccatgctggtgaattttgcccaaggcgggttggctcgccttgaaggtgatttagatctcgcgacctatcattatcaacaaatcctgcatcaacaacctgactttccccgtatcgagctggaattggcccgtatctattttgaagatcaccagaatcgggaagccaagcaactctttactggattgaatgaaaaacaacagctgccagccgctgtcctgaagaatattaacagctatctggaagcgatagagctgagaacaggctggcggggctctttttcggcaggttatgcctataacgataacgtcaatatgtcctctaatcatggccccatctgcttaagctactctatgggtatatgcacaaagaagcagcaagttcccaaagcgatcaaagcatggggaatgtcttacgatgcaacgttaagccggcgttatcagctttctgaccatcacggcatttttggccgaggtctgatgtatggagaaaactaccgcaattatcacgatgggaatgagaatacattcctgctggtcggtggatataactttaaaaacagaaatcacgatttctcctttggccccctgtttgaatataaacagcgcacagatgacaccacttaccgcgccatcggtgctaaaacagagtggagatgggcattcaccaataagaccaccctgaatattgagcttgaacataaacaactgcggcatcaggagcaacgttatcgcagaaaagatggcgaactttcttcaacctacctcacgttatcccatgccattaacaaaaacgttgtcctgtttggcggcggtgactggctgtaccgaaacaacgaccattatcgcgaagacagctatcagcaatggggaattcgggcagggatcgccggggaactttattccggcatcactggctcactgtttgccacgttgaaagagcggcgctttggtgcttacaccccgatgctgaacgccacacgtcaggatactgaacaaatttacacagcggttatcaaagtacccgctgccgaaatactgggcatgacgccttctcttactttccgccaccgacgtaaccacagcaatgtggattggttatacagctataacaaaaacgaagtgctgattaggctggagaagtatttttaa

SEQ ID NO: 680 - protein, 491 aa, X. nematophila
MSDNRTTPILAAALIALCLSLSVYADEDTSRNIWLDAQHNQQENETNLITPDPIFMGSNSSFIVINGQTFQVGNNINDLGQALFLAINHQQWPDVRRFLAAYQKLPEHDAMLVNFAQGGLARLEGDLDLATYHYQQILHQQPDFPRIELELARIYFEDHQNREAKQLFTGLNEKQQLPAAVLKNINSYLEAIELRTGWRGSFSAGYAYNDNVNMSSNHGPICLSYSMGICTKKQQVPKAIKAWGMSYDATLSRRYQLSDHHGIFGRGLMYGENYRNYHDGNENTFLLVGGYNFKNRNHDFSFGPLFEYKQRTDDTTYRAIGAKTEWRWAFTNKTTLNIELEHKQLRHQEQRYRRKDGELSSTYLTLSHAINKNVVLFGGGDWLYRNNDHYREDSYQQWGIRAGIAGELYSGITGSLFATLKERRFGAYTPMLNATRQDTEQIYTAVIKVPAAEILGMTPSLTFRHRRNHSNVDWLYSYNKNEVLIRLEKYF

SEQ ID NO: 681 - DNA, 1401 bp, X. nematophila
atgaaaaaaatcaaatccatcgttataactgttgttaccaccctgcttatccctataagcaacgtcgtaatagccgaagaaataaaacctcagaatcaaaacgtatatacggaagacgaaatattaaggcaacctagattacttgaaaatgcaattctctttttaattcatgaacaaaatgataacctagagaaagtacttagcctttataaaaagtcgcatagtcaagatccttacctgattctttgggctgaggcgaaaatcctcatgaaaaaaagagaataccatcaggctattaataagttagaacaatttgtcaatcagtatgataacccaaccgctaaatttgatttggccatactttacttactcaataaaaaatacaatcaatccgaaaatattttcaacaatttactgcttaccacccgtaatcaacaggataaggaaagtataaataattatatagaatacattaaaaagaaaaaggaaattaaatttaatacatatttttcattcaaaagagattcaaacatctcaaaaatcactgataaaaaagtatatggatgggatccaaataaaaggataaaagatgtgggattgtcttttaccccacgcattagcaaaaagtatttttttgactctggtttattctctgaatttgatattgatgctcatggaattaagtatctgaaagaaaaaagatatgatttcttaagcaccagaataggcaataaaatcgggtttgaagattactccaattatttctacttaaaacctttttatataaagtcattttatggtggcggttcgacatcatcatctaaagaaataggttttaaacctttttatgatgcaattgggtttaacttatttaaattatcagatataaatgaaaatcttaaatatgccattttctatgaaaataaaaatgaatattataacaagaaaaaacatcttaatggagacattaactttgttagcggttcattaatatttatcccatttaatgatttatatatgtccttatctggaagttatagtgtaaccgatagaagatctaaagaggatagtcatcatgacaaagggatgacttttctaatcagcaaacgctttttagatgattatttagtagagctaaactatcaaaagataaaaactgactatataggtaaaaccactatatatactccagctcatatctttattcgagatttaccccccattaaaataaaaagagaagatattactgattccgtctcgctttcactctcaaatgagagtattaatttatttggtttttacccgacactctctttttcctatacaaaaaacaaaagcagcaatcttttttattcttatactgaaaaagatatttttctggacttcaagcgtaatttttaa

SEQ ID NO: 682 - protein, 466 aa, X. nematophila
MKKIKSIVITVVTTLLIPISNVVIAEEIKPQNQNVYTEDEILRQPRLLENAILFLIHEQNDNLEKVLSLYKKSHSQDPYLILWAEAKILMKKREYHQAINKLEQFVNQYDNPTAKFDLAILYLLNKKYNQSENIFNNLLLTTRNQQDKESINNYIEYIKKKKEIKFNTYFSFKRDSNISKITDKKVYGWDPNKRIKDVGLSFTPRISKKYFFDSGLFSEFDIDAHGIKYLKEKRYDFLSTRIGNKIGFEDYSNYFYLKPFYIKSFYGGGSTSSSKEIGFKPFYDAIGFNLFKLSDINENLKYAIFYENKNEYYNKKKHLNGDINFVSGSLIFIPFNDLYMSLSGSYSVTDRRSKEDSHHDKGMTFLISKRFLDDYLVELNYQKIKTDYIGKTTIYTPAHIFIRDLPPIKIKREDITDSVSLSLSNESINLFGFYPTLSFSYTKNKSSNLFYSYTEKDIFLDFKRNF

SEQ ID NO: 683 - DNA, 1464 bp, X. poinarii
atgtctgacaataaaacaacacctgtgttattagcggcactgatggctttatgcctctccctgcctgtttatgccgatgaagatacgccccgaaaaatctggcaggaagcacaacataaccaacaagagaatgaaacaaacctgattgcgtcagagcctgtttttactgaggataatacgtcactgattgtcattaatgggcaaacatttcaggttgaaaataatattaatgatattggtcaagcgcttttcctcgccataaaccaccaacaatggtcggatgtcagacgcttcctcgcggcttatctgaaattgccggatcatgatgcaatgttagtcaattttgcccaagggggtctggcacgccttgaaggcgatttggatctcgctacctatcattaccaacagatcctgagccaacaacctgattttacccgtatcaaactggaactcgcccgggtctattttgaggatcataaaactcgggaagccgaacaactatttactgaattaaatgaacaacagctattaccaaaaaccgtattgaagaacattcacagttacctggaagcgatagcgctgagaaatggctggcgcggatctttttctatgggttatgcctataatgataacgtcaatatgtcgtctgatcagaagacagtaaaaaatctgataaaccaaatagtagagcagaaaacatccaaagccatcaaagcttggggcatgtcttatgacgcaacattaagccgacgttatcaactttttggtcaccatggtatttttggtcgtgggctgatttatggcgaaaattaccgtgatcaccacaatgaaaacgaaaacacgttcctgctggttggtggttacaactataaaagcaaacgtcacgatgtctcttttggcccattatttgaatataaacaacgtgcggacgataccttttaccacgccgccgggatcaaaacggaatggcgatggggattcacgcctcacacagccctaaatatagaacttgaatataagaaactgcgacatcaacaactttaccgtagaaaagatggtgaattatcttccacttacctcaccttgtcccatgttatcaacaaagatttcgttctgtttggtggcggtgattggctttatcgcggcaacgacgactatcctgtcgatcgttatcagcaatggggcattcggacggggattgccgggcagatttatcccggaatcaacggttcactgtttgctacgttgaaaaaacgccagtttggcgcttacaaccccatgctcaatgcccgacgtcaggataccgagcaaatttacaccgcagtgataaaaataccagccgccgaaatattcagcatgacaccatccctaacttttcgccaccgacacaatcgcagcaatgtggattggctgtacagctataacaaaaatgaagtgttgataagactggaaaaatatttttaa

SEQ ID NO: 684 - protein, 487 aa, X. poinarii
MSDNKTTPVLLAALMALCLSLPVYADEDTPRKIWQEAQHNQQENETNLIASEPVFTEDNTSLIVINGQTFQVENNINDIGQALFLAINHQQWSDVRRFLAAYLKLPDHDAMLVNFAQGGLARLEGDLDLATYHYQQILSQQPDFTRIKLELARVYFEDHKTREAEQLFTELNEQQLLPKTVLKNIHSYLEAIALRNGWRGSFSMGYAYNDNVNMSSDQKTVKNLINQIVEQKTSKAIKAWGMSYDATLSRRYQLFGHHGIFGRGLIYGENYRDHHNENENTFLLVGGYNYKSKRHDVSFGPLFEYKQRADDTFYHAAGIKTEWRWGFTPHTALNIELEYKKLRHQQLYRRKDGELSSTYLTLSHVINKDFVLFGGGDWLYRGNDDYPVDRYQQWGIRTGIAGQIYPGINGSLFATLKKRQFGAYNPMLNARRQDTEQIYTAVIKIPAAEIFSMTPSLTFRHRHNRSNVDWLYSYNKNEVLIRLEKYF

SEQ ID NO: 685 - DNA, 1485 bp, X. poinarii
atgtctgataaaagaaaagcgactgtcttactgacaccactgctgatctcagtcctctctctggacgtccatgccagtcatgaagatattcaccagaaaatctggcaagaagcacgataccaccgacaacataatcaacaacagaatgaagcggatttaacaatgccggagaccctttcaacccagaagggtgtttcatggctcgtcattcacgggcaaaaattaaagataagaaacaatattaacgacatcggccaggcactgtacctcgcgattaacgatcagcaatggcaagaggtcagctatttcctggccatttatcaaaaaatgcctgcgcacgatccattacttgtctatcttgctaaaggcgcgctggcacgtattcaaggcaatttggcactcgcaatagcttattatcaaaagatcctgcaccaacaacccaacttcacccgcgccaaactggaactggcccgtctttattttgaagatcagaacaatcgggcatctgaaacattatttaaagagatcaggcaacagcatcaattacccaacatggtcttaaagaatatcgatcgttatctgcaagcaataaaccaaagagacggctggcacggttccttctcattcggttatgcctatgatgataatatcaacatgtctccaaatcagaaggcgagttgtctggtattcaaaagcggaaagtgtgtgttagaacggcacatcccgaaacctatcaaagaagggggggaaacatataacgcgacattaagctggcattatcaacttgttggtcaccacggtatttttggtcgtagcctgatttatggtgaacattatccccattaccacgatgaaaacgaaaatacgtttctgctgatcggcggttacaactataaaaacagaacccaggatttttcctttggtcctgagtttgaatataaacatcatgccggcaataccgaataccatgccatcggtgccaaaatagagtggtactggaacatcaccgatcaaaccgccctgaatgttgaacttgggcataagaaattaacttttcagccgctttaccactggaaagaaggttcgcttttttcatcctatttcagactctctcatgccatcagtgatagcactgttctgtttggcggtggcaactgggattaccgccatgctcaacaacccacggttcgctatcaacaatggggagtcaataccggcataaccgggcagctctattccggcatacatggctcgctgtttatcacgctgagaaaacaacaaatggggagatatgaccctttattgaacgccagacgtcaagataatgaactgatctctacggcttcggttacatttcctggcactaaaatcggcggaatgaccccctccatcacgttcaagcatcgacataatcgcagtaatgtgaactggttatacagttatgataaaaacgaagtacaaatccaactagagaactatttttaa

SEQ ID NO: 686 - protein, 494 aa, X. poinarii
MSDKRKATVLLTPLLISVLSLDVHASHEDIHQKIWQEARYHRQHNQQQNEADLTMPETLSTQKGVSWLVIHGQKLKIRNNINDIGQALYLAINDQQWQEVSYFLAIYQKMPAHDPLLVYLAKGALARIQGNLALAIAYYQKILHQQPNFTRAKLELARLYFEDQNNRASETLFKEIRQQHQLPNMVLKNIDRYLQAINQRDGWHGSFSFGYAYDDNINMSPNQKASCLVFKSGKCVLERHIPKPIKEGGETYNATLSWHYQLVGHHGIFGRSLIYGEHYPHYHDENENTFLLIGGYNYKNRTQDFSFGPEFEYKHHAGNTEYHAIGAKIEWYWNITDQTALNVELGHKKLTFQPLYHWKEGSLFSSYFRLSHAISDSTVLFGGGNWDYRHAQQPTVRYQQWGVNTGITGQLYSGIHGSLFITLRKQQMGRYDPLLNARRQDNELISTASVTFPGTKIGGMTPSITFKHRHNRSNVNWLYSYDKNEVQIQLENYF

SEQ ID NO: 687 - DNA, 1467 bp, X. szentirmaii
atgcctgacaataaaacaagaccaacattatccgcggcacttgctgtgctatgtctttccctgacggctcatgccgatgaagatatttcacggaaaatctggcaggaagcacaacataaccagcaggaaaatgaaaacaatctggtcacgccagaccctgtttttatcgaagatgacgcttcattgattgtgattgatgggcaaccgtttaaggtagaaaataatctgagcgatatgggacaagcactttaccttgccactaaccatcggcagtggccggatgtcaggcgttttctcgctgcttaccaaaaattatccgggcatgatgagatgttgcttcattttgcccaaggcggattggcccgttttgaagaaaattttgatcttgccgcctatcactatcagcagattttaaaccaacaacctgatttcacccgcatcaaactggagctggcccgcgtttattttgaggatcataagactcgggaagccagacagctgttttctgtgttgagtgaacaaagtcaactaccggaaaccgtcttaaaaaatatcaacagctatctggaagctatagcgctgagaaacagttggcgcggctctttctctgcgggttatggctataacgataatgtgaatatgtcttctgatagtggcgcaatccggtattgcggcgaaaaaagctgtgtattggttcaagtaccaaaagccgttaaagcgtggggtttgtcttatgacgccatcctgaaccgccgttatcagtttgtcggccatcacggcatttttggccgtggtctgatgtatggggaaaattaccggcattaccatgacggggatgaaaatacgctgttgctggtcgggggatataactataaaagcaggcatcacgatgtttctttgggtcccttgtttgaatataagcaacttgcaggtgatattttttatcgtgcaaacggtgccaaaacagaatggcgatgggctttgacctcccaaacagccttcaatgcagaaattgaacataaacgactgcgccatcaacaacaacttcagcggaaagacggcacactttcatcaacttactttactttatcccatgcccttaatcgcgacatggttctgtttggcggcggggattggctctatcgcagcaatgataaatacgacatggacagctaccggcaatggggagctcgggcaggtattgccgggcaactctaccccgggatcaccggatcactgtttgccacggtgaagaaacggcaatttgatgccaaacaccccatgctgaacatcctccgtgaggataatgaacaaatttatactgctgtcattaaagtgcctgccgctgaaatcgggggcatgaccccttctctgacgttccgccaccggcgcaatcacagcaatgtggcttggctgtacagctataacaaaaacgaagtgctgttcaggctggaaaagtatttttaa

SEQ ID NO: 688 - protein, 488 aa, X. szentirmaii
MPDNKTRPTLSAALAVLCLSLTAHADEDISRKIWQEAQHNQQENENNLVTPDPVFIEDDASLIVIDGQPFKVENNLSDMGQALYLATNHRQWPDVRRFLAAYQKLSGHDEMLLHFAQGGLARFEENFDLAAYHYQQILNQQPDFTRIKLELARVYFEDHKTREARQLFSVLSEQSQLPETVLKNINSYLEAIALRNSWRGSFSAGYGYNDNVNMSSDSGAIRYCGEKSCVLVQVPKAVKAWGLSYDAILNRRYQFVGHHGIFGRGLMYGENYRHYHDGDENTLLLVGGYNYKSRHHDVSLGPLFEYKQLAGDIFYRANGAKTEWRWALTSQTAFNAEIEHKRLRHQQQLQRKDGTLSSTYFTLSHALNRDMVLFGGGDWLYRSNDKYDMDSYRQWGARAGIAGQLYPGITGSLFATVKKRQFDAKHPMLNILREDNEQIYTAVIKVPAAEIGGMTPSLTFRHRRNHSNVAWLYSYNKNEVLFRLEKYF

SEQ ID NO: 689 - DNA, 1551 bp, X. szentirmaii
atggattttgctgctatgacttgcaagaaaaagaccgctgtttctacattattgttcatggcatcactggccttatttcactctccggcagcctattcccatcaagatggtagtcatgaagcgtttacaagtgaagaaagtacccattggatctggaaagaaatacggcacaatcaacagcaaaaccaacaaaaacatgaagcgggcctgagtataccggctgttgtttcgacggaagaggatgaatcaaaagagggtaaatcgtcgggcacaggtcatgggcaaccctttgagattgaaaataatcctgaaaacctggcgaaggcactgtattttgctattaactatcaacgctggtcagaagttaaacgcttgctggcggtttatcagaaaatacctgagagcaatccgttactcgtcgattttgctcagggcgggctggcccgcatcgaaggaaagttggcactttctgccgctcattatcaaaagatactgagtcaacaacctaattcaacacgcataaagctggaactggcccgtgtctattttgaagattacaacaatcgggaagctgaaaaattatttagtgaattaagagaacagcatcagttaccgaaaatagttctggagaatattgaccgttacctccacgcaattcccctgagaagccgttggcacagttcattttccatcagttctgtctatgatgataatttaaatatgacgccaaatcaggaagcccaatgtctgcttattctggaaggacattgcctcatgcaacgaaaattacccaaaatcatcaaagagtgggggagtacatatactgcgacattgagccggcgctattcatttgctggtcatcacggtgtttttggccgtgccctgatttacggggaaaattacccacactatcatgacgcaaatgaaaacatattcttgctggtcaatggctacaattataaaaacaggactcatgacttatcctttggtcccttgtttgaatataaacagagtgcaggaaagacggaatattacgcgctcggcgctaaactcgagtggcaatgggcaatgactgcccagactggcctgaatgtggaaatatcaaataagcggctgaattatcagcaaaatgacagtgttaaaaatggctcactttcctcatcctatttcagcttatcccacttcatcaacgacaaagttattctgtttggcggggggcaatggagctatcaggacagccagcgcccctcatcccgttatcagcaatgggggataactgccgggattgcaggacaaatttactctggcattaatggctcgttggttgccacactaaggcagctgcgttttgcagcctacaacgccgtattggaggccagacgccaagataatgagcaaatttatacagcgtccattaaatttccaaaagccaagatcgtgggcatgaccccctctttaattttccggcatcgacataatcgcagtaatgtggactggctttacagctatgataaaaaccaagtgcaaatacaactggagaaatatttttaa

SEQ ID NO: 690 - protein, 516 aa, X. szentirmaii
MDFAAMTCKKKTAVSTLLFMASLALFHSPAAYSHQDGSHEAFTSEESTHWIWKEIRHNQQQNQQKHEAGLSIPAVVSTEEDESKEGKSSGTGHGQPFEIENNPENLAKALYFAINYQRWSEVKRLLAVYQKIPESNPLLVDFAQGGLARIEGKLALSAAHYQKILSQQPNSTRIKLELARVYFEDYNNREAEKLFSELREQHQLPKIVLENIDRYLHAIPLRSRWHSSFSISSVYDDNLNMTPNQEAQCLLILEGHCLMQRKLPKIIKEWGSTYTATLSRRYSFAGHHGVFGRALIYGENYPHYHDANENIFLLVNGYNYKNRTHDLSFGPLFEYKQSAGKTEYYALGAKLEWQWAMTAQTGLNVEISNKRLNYQQNDSVKNGSLSSSYFSLSHFINDKVILFGGGQWSYQDSQRPSSRYQQWGITAGIAGQIYSGINGSLVATLRQLRFAAYNAVLEARRQDNEQIYTASIKFPKAKIVGMTPSLIFRHRHNRSNVDWLYSYDKNQVQIQLEKYF

SEQ ID NO: 691 - DNA, 1413 bp, Xanthomonas sp. SHU199
atggcgcaggcgcaggacgatacccgacgcctgctcgaacagcgcgaccagggccaggcgctcgaacgcgaacgcgcgctggtgcaggagccggccaccggcgagcgaccgagcatcgtcgtcgacggcatgtcctacgtcgtcgcgccgaccgccaacgacgtcggccgcgcgctgtacctgtcgcttcagaacaaacaatggccggccgtgcagcggttcctcgccgaatacctgaccctgcccgagcgcgacccgctgctggtgcattacgcgcagggcgcggtggcgcgcaaccgcggccgctacggcgacgccgagcgggagtaccgcgcgctgctgaagttgcagccggacttcctgcccgggcgtctggaactggcgcgggtgctgttcgaggaccagcaggaccgcgaggccgaacaggcgttcgcagccattgccgcctcgatcgacgctggcgatcccaggaccgagggtgtgcgcaacaccatcgccggcttccgccaggccttggccaaccggcgcgactggaacggcaccttcgcgctgggaccggcctggagcgacaacgtcaatcgcacctcggccagttccatctgcctgctgccgctggaagggcgctgctacttcagccgcagcacgcccacggcgatcgtcgccttcggcgccgactacgatgccagcgccgaacggcgcctgccgctgcgcggtcaccatgggctgtacctgcgcacgctgctgttcggccagagctatcgcgacaacggcgcctacaacgaactcaccgcgctgacccaggccggttacagctatcgcagcggccgccacagcctggcgctggcgccctcgttcgattactacgcgctgggcaaccaggcgctgtatggcgcctggggcgtgcatgcggaatggagttggagcctgtcgccgcggtcgctggtcaagctggaaggcgactggaaggacatgcgctaccgccgccgcgcttacgccgccagctacgacgcgatcgtgcgcggcgcctcggccacctatttccgcagcctggatgcgcgctggaccgtgttcgccggggtcgacgccagcgacactgccgccgtgcaggacaccgaggcgtacctgcagcgcggcgtccgcctgggcggttcgcggcaatggccgggaggcatcgacgccaccgtgttcgcctcctaccggctgcgcgactacggcgcctacagcgcggtcctgcgcgcacgccgccacgatgccgagcgcacctacaccctggtgctgcgcgcgccgcgcctggcggtcggcggcttcgtgccgctgctgacgctgcgccacaaccgcgtgcgcagcaacgtcgactggctgtacggctacgagcgcaacaccatcaacctgaaactggagcgcgccctgtga

SEQ ID NO: 692 - protein, 477 aa, Xanthomonas sp. SHU199
MAAAPCAMAQAQDDTRRLLEQRDQGQALERERALVQEPATGERPSIVVDGMSYVVAPTANDVGRALYLSLQNKQWPAVQRFLAEYLTLPERDPLLVHYAQGAVARNRGRYGDAEREYRALLKLQPDFLPGRLELARVLFEDQQDREAEQAFAAIAASIDAGDPRTEGVRNTIAGFRQALANRRDWNGTFALGPAWSDNVNRTSASSICLLPLEGRCYFSRSTPTAIVAFGADYDASAERRLPLRGHHGLYLRTLLFGQSYRDNGAYNELTALTQAGYSYRSGRHSLALAPSFDYYALGNQALYGAWGVHAEWSWSLSPRSLVKLEGDWKDMRYRRRAYAASYDAIVRGASATYFRSLDARWTVFAGVDASDTAAVQDTEAYLQRGVRLGGSRQWPGGIDATVFASYRLRDYGAYSAVLRARRHDAERTYTLVLRAPRLAVGGFVPLLTLRHNRVRSNVDWLYGYERNTINLKLERAL

SEQ ID NO: 693 - DNA, 1413 bp, Xanthomonas sp. SHU308
atggcgcaggcgcaggacgatacccgacgcctgctcgaacagcgcgaccagggccaggcgctcgaacgcgaacgcgcgctggtgcaggagccggccaccggcgagcgaccgagcatcgtcgtcgacggcatgtcctacgtcgtcgcgccgaccgccaacgacgtcggccgcgcgctgtacctgtcgcttcagaacaaacaatggccggccgtgcagcggttcctcgccgaatacctgaccctgcccgagcgcgacccgctgctggtgcattacgcgcagggcgcggtggcgcgcaaccgcggccgctacggcgacgccgagcgggagtaccgcgcgctgctgacgttgcagccggacttcctgcccgggcgtctggaactggcgcgggtgctgttcgaggaccagcaggaccgcgaggccgaacaggcgttcgcagccattgccgcctcgatcgacgctggcgatcccaggaccgagggtgtgcgcaacaccatcgccggcttccgccaggccttggccaaccggcgcgactggaacggcaccttcgcgctgggaccggcctggagcgacaacgtcaatcgcacctcggccagttccatctgcctgctgccgctggaagggcgctgctacttcagccgcagcacgcccacggcgatcgtcgccttcggcgccgactacgatgccagcgccgaacggcgcctgccgctgcgcggtcaccatgggctgtacctgcgcacgctgctgttcggccagagctatcgcgacaacggcgcctacaacgaacttaccgcgctgacccaggccggttacagctatcgcagcggccgccacagcctggcgctggcgccctcgttcgattactacgcgctgggcaaccaggcgctgtatggcgcctggggcgtgcatgcggaatggagttggagcctgtcgccgcggtcgctggtcaagctggaaggcgactggaaggacatgcgctaccgccgccgcgcttacgccgccagctacgacgcgatcatgcgcggcgcctcggccacctatttccgcagcctggatgcgcgctggaccgtgttcgccggggtcgacgccagcgacactgccgccgtgcaggacaccgaggcgtacctgcagcgcggcgtccgcctgggcggttcgcggcaatggccgggaggcatcgacgccaccgtgttcgcctcctaccggctgcgcgactacggcgcctacagcgcggtcctgcgcgcacgccgccacgatgccgagcgcacctacaccctggtgctgcgcgcgccgcgcctggcggtcggcggcttcgtgccgctgctgacgctgcgccacaaccgcgtgcgcagcaacgtcgactggctgtacggctacgagcgcaacaccatcaacctgaaactggagcgcgccctgtga

SEQ ID NO: 694 - protein, 477 aa, Xanthomonas sp. SHU308
MAAAPCAMAQAQDDTRRLLEQRDQGQALERERALVQEPATGERPSIVVDGMSYVVAPTANDVGRALYLSLQNKQWPAVQRFLAEYLTLPERDPLLVHYAQGAVARNRGRYGDAEREYRALLTLQPDFLPGRLELARVLFEDQQDREAEQAFAAIAASIDAGDPRTEGVRNTIAGFRQALANRRDWNGTFALGPAWSDNVNRTSASSICLLPLEGRCYFSRSTPTAIVAFGADYDASAERRLPLRGHHGLYLRTLLFGQSYRDNGAYNELTALTQAGYSYRSGRHSLALAPSFDYYALGNQALYGAWGVHAEWSWSLSPRSLVKLEGDWKDMRYRRRAYAASYDAIMRGASATYFRSLDARWTVFAGVDASDTAAVQDTEAYLQRGVRLGGSRQWPGGIDATVFASYRLRDYGAYSAVLRARRHDAERTYTLVLRAPRLAVGGFVPLLTLRHNRVRSNVDWLYGYERNTINLKLERAL

SEQ ID NO: 695 - DNA, 762 bp, A. actinomycetemcomitans
atgagtaattttaaacactcaatttcaaaattgagtcttattgtattaacatcattaaccgttgcagcttgcggaagtggcggcggtggttccggtactccgacacctgtagttaatactggcgctgtattttcagtttcagaaaaaggtgctgtatcaaaaacttcaataaatagtaattcaaatctaaaagcgttagatattgctggacataaaattaatctacttgaagattctgatagttatagttttataggcgagaacaatagcctttatcaatatggttatttatcttctaagacagaagatttccctaatgatcaagtattttacaatggagaaattgctaaaaatattcctaatgcgggtgaagtccgctattccggtagtgtagttataggtggtcagaagagtgatggcgcccctatcggagctagtgagcaattaacaaaaggtaaagcagaaattagagctgattttgggtcaaaaaaattagatggtaaatttatttttaagcctgatactttagagcgtacaggagaattatctgaacaagtggttcaaatgaacgcaactatttctaataacagttttgagggaaaagctacatctaagcatttatctggcgaggctaccgtggagggtaaattctatggtaataatgccgaagcattggctggcgcatttcatagatcaggagacaaaccttggtatggtgcgtttggtgcaaaaaaagatgacagtgctaaacctaatccatag

SEQ ID NO: 696 - protein, 253 aa, A. actinomycetemcomitans
MSNFKHSISKLSLIVLTSLTVAACGSGGGGSGTPTPVVNTGAVFSVSEKGAVSKTSINSNSNLKALDIAGHKINLLEDSDSYSFIGENNSLYQYGYLSSKTEDFPNDQVFYNGEIAKNIPNAGEVRYSGSVVIGGQKSDGAPIGASEQLTKGKAEIRADFGSKKLDGKFIFKPDTLERTGELSEQVVQMNATISNNSFEGKATSKHLSGEATVEGKFYGNNAEALAGAFHRSGDKPWYGAFGAKKDDSAKPNP

SEQ ID NO: 697 - DNA, 792 bp, A. baumannii
atgaaaatctctcaactgttcatcgctctggttgcatgttctgcggtattcagccatgcagcaattgaaggcgcttcaagcaatgaagcaaatatcaaagtcggtgcggcagcaaatgccagtcatagcggtggaacagctgccgtttcagtagaggcggcaggtgcaccttataatgcattcaccggttttagttcactcaaaggtctagcgcaggcatttgctgcacaaggaaccagcaatagcaatgtaactgtgggtagcaagagctttaatatctctcacattcctgtctctgcaatgccgccttcacatagcgctttaggtaattttaactttggccaggtcggcacacaggaagtttatttcggtgaatggtggaaagcaggtgatacgcctgccagcgcaagccatacggtttattacgcaggtgacaataccaataccacagtacctaccgcagggacggcaacctataccgttgcagggattaatggcttggtagccaatctgttaactggtaatttcactgcaaacttcggtgcaggcacgctcgaaggatcattaaccggaaccggtactagcgtttcaaacttaacactggatggcgtgacctttaatccgggttcggctgcatttagcggttttgcaattgcaaatggtaccgccggcttaaatgattccggagctgttcagggacatttctttggcgcaaatgcggctgctttagcgggtatcgcgaaatttgacaatgtgtcttataacacggcatttggcggtgcgaaaaactaa

SEQ ID NO: 698 - protein, 263 aa, A. baumannii
MKISQLFIALVACSAVFSHAAIEGASSNEANIKVGAAANASHSGGTAAVSVEAAGAPYNAFTGFSSLKGLAQAFAAQGTSNSNVTVGSKSFNISHIPVSAMPPSHSALGNFNFGQVGTQEVYFGEWWKAGDTPASASHTVYYAGDNTNTTVPTAGTATYTVAGINGLVANLLTGNFTANFGAGTLEGSLTGTGTSVSNLTLDGVTFNPGSAAFSGFAIANGTAGLNDSGAVQGHFFGANAAALAGIAKFDNVSYNTAFGGAKN

SEQ ID NO: 699 - DNA, 759 bp, A. bereziniae
atgaaacttcaatctatctcactggctgttttactatctattggtttagtcggtgctgctcaggcagctatagtcggtgagtcgagtgatgttagtaaaatcgaggtcgcagctacaggttcactggggccaaaccatccaaactcgggtgtaggtttcggaatcaaagacttttataacggcgcagttgttgcattctcgggttttaacggttatgcagatggcaatggggtagtgcgtttgaacccgtatttaccaggtcttccgccaacacatgctgctatcggttatgccaactataaacaagtgcctacgcaagacgtttggtttggtgagtggaatgccgaagccaaagatgccagtggaaaccgtctaggtacagttgatccaacaacacatactgtttattacaatggtaaagatgcggataccagcgtaccgtctacaggtactgcaaattatagcgttcaaggtgtcaataattataatggctctaatttgttgtcaggtacgtttactgcaaactttgcaaccaaacagttaactggttcattgagcgatagttcacgtacctttaatttaggtactgcaacaattaataatgacgctacgattagtggttcaaatgcatcttggacaggtggaccttctggtggtgatgtttcaggtcagttttataatagccaaagcagcttagcaggcattgcaacatttgtaggtaacaatacatatgatgttgcattcggcggtaagaaataa

SEQ ID NO: 700 - protein, 252 aa, A. bereziniae
MKLQSISLAVLLSIGLVGAAQAAIVGESSDVSKIEVAATGSLGPNHPNSGVGFGIKDFYNGAVVAFSGFNGYADGNGVVRLNPYLPGLPPTHAAIGYANYKQVPTQDVWFGEWNAEAKDASGNRLGTVDPTTHTVYYNGKDADTSVPSTGTANYSVQGVNNYNGSNLLSGTFTANFATKQLTGSLSDSSRTFNLGTATINNDATISGSNASWTGGPSGGDVSGQFYNSQSSLAGIATFVGNNTYDVAFGGKK

SEQ ID NO: 701 - DNA, 1245 bp, A. capsulatus
atgaaaaatattttaaataaacaagtattaaatacggcagcaacaattttgttatctatcgtagtaacggcgtgttcatcaggaggaagtgatcagcccggaattgatcaaagtacacgcttaagccaagtggcggtacaaaatttattagaagataaattacaagctcaagaacaccttgaagtaataaaaaaggcattggttgatcttcaattagctttagttaaagcacaatcggctaattcgacatcagatgcacaacaagtattaaaagatgccaatagcttattagaaaaagcgaaattggcagccgaaaatgctaaaaatgaagctaaaaatgccgcttcacgggtctcaaatgcaagtgcgcaactatctactgctgtagatgaagcgaataatgtaatgaacattgcgaatcaggcaaatagcgtgttattagaggcaactaacacctttaatcaaattcagtcggtgcttgctgatttaactcaaaaagaggtgacaaaagccgaagagcagacgaaaaaaatcgcacaagaaaagcaaattgcgacaaataaagcgattactactgcaatatcttataacaaccttgattcgattgtgcatgattatagtaatagtgaagcacgagaagtattattagcaaaattacaaaaacaaggttcaaatgcgccggcatcttgtagtaatgcaaaaacgtcaacttgctataaagaagtggcaagaggtagtgtcatagtcaattacaaccaagcttactcaagttatgcggttattcgtgagacttacaataatgaaaacttacagccgagtaatgcttttattgtattagcgaaggagagtgatttaactacagagcgtgcggcggttgtaaatgcgacctatacgggtaaagcgtcttatagtgcgaaaaatgtgcctgctgtaatgacacgagacttcaccttaaaagtggaaaatgacaaggtcagcggctcggttttccaaaaaacgattaattcgaaaggtatagaaaaagtaacggaaaatgtagcgttaaatgaaggaaagatcagggttgagaacggcgtagtaggctttagtggctcagcaaaattcggggcgattgcaagcaatgccgaaggttcttataaaggcgtattcgtaggcaaaaatgcggaagaagtgatcggtacttttgaaacaaatagcacagaaaaagcctcttcggcgcaaggtgcttttgcaggaaaaaaataa

SEQ ID NO: 702 - protein, 414 aa, A. capsulatus
MKNILNKQVLNTAATILLSIVVTACSSGGSDQPGIDQSTRLSQVAVQNLLEDKLQAQEHLEVIKKALVDLQLALVKAQSANSTSDAQQVLKDANSLLEKAKLAAENAKNEAKNAASRVSNASAQLSTAVDEANNVMNIANQANSVLLEATNTFNQIQSVLADLTQKEVTKAEEQTKKIAQEKQIATNKAITTAISYNNLDSIVHDYSNSEAREVLLAKLQKQGSNAPASCSNAKTSTCYKEVARGSVIVNYNQAYSSYAVIRETYNNENLQPSNAFIVLAKESDLTTERAAVVNATYTGKASYSAKNVPAVMTRDFTLKVENDKVSGSVFQKTINSKGIEKVTENVALNEGKIRVENGVVGFSGSAKFGAIASNAEGSYKGVFVGKNAEEVIGTFETNSTEKASSAQGAFAGKK

SEQ ID NO: 703 - DNA, 792 bp, A. gyllenbergii
atgaaaatctctcaactgttcatcggtcttgttgcatgttctgctgtgtttgcacatgcaggtattgatggtgcttcaagtaatgaaaacaatatcattattggtgctgctgcaaatgccagccacccaggtggtgcagcagccgtttctgtacaagcggctggtgcaccctacaatgcatttacaggttttagctcgttaaaaggtttggcacaagcgttcactgcacgcggtgcaagcaatactgatgttactgtcggtagcaaaacttttaatatctcccatattcctgtttcggcaatgccaccttcacatagtgccttaggtaatttcaattttggtcaggtgggctcacaggaagtctattttggtgaatggtggaaagcgggtgatacagcagcaagtgcaagtcatactgtttattacgcaggtgacaataccaatactacagtaccaacctctggtacggcgacttataccgttgcagggattaatggttcagcaaccaatctgctaagtggtaatttaactgctaactttggtgcaggtactttagaaggatcattaactggaacagggactgctgtttcaagcttaagcttaaatggtgtgacatttaatccaggtactgcggcattcagtggcggcgctagtgcaaatggtacggctgggctaaataattcaggtattgttcaaggacacttctttggtgcaaatgccgcagctttagcgggtattgccgagtttaacaatgctgcttataacactgcctttggtggtgcgaaaaactaa

SEQ ID NO: 704 - protein, 263 aa, A. gyllenbergii
MKISQLFIGLVACSAVFAHAGIDGASSNENNIIIGAAANASHPGGAAAVSVQAAGAPYNAFTGFSSLKGLAQAFTARGASNTDVTVGSKTFNISHIPVSAMPPSHSALGNFNFGQVGSQEVYFGEWWKAGDTAASASHTVYYAGDNTNTTVPTSGTATYTVAGINGSATNLLSGNLTANFGAGTLEGSLTGTGTAVSSLSLNGVTFNPGTAAFSGGASANGTAGLNNSGIVQGHFFGANAAALAGIAEFNNAAYNTAFGGAKN

SEQ ID NO: 705 - DNA, 792 bp, A. haemolyticus
atgaaaatctctcaactgttcatcggtcttgttgcatgttctgctgtgtttgctcatgcaggtattgaaggtgcttcaagtaacgaagcaaatataaaaattggtgctgcggcaaatgcaagtcatcctggtggcgctgctgcggtttctgtacaagcagcgggtgcgccatataatgctttcacaggctttagttcattgaaaggcttggcacaagcatttgccgcacaaggtacaagcaataccaatgtcactgtgggtactaagacctttaatatctctcatattcctgtatcggcgatgccaccttcacatagtgctttaggtaattttaatttcggtcaggtgggtacacaggaagtttatttcggtgaatggtggaaagcaggtgatacacctgctagtgcaagccatacagtgtattacgcaggcgataataccaataccacagtaccaactgcaggtactgcaacttataccgttgctgggattaatggatccgcgacgaatctgttaactggtaatttcactgcgaactttggaacaggtactttggaaggttcattaacaggaacaggcactgctgtttcaagtttaaccttgaatggggtggcatttaatcctggtactgctgaatttggtggtgcagcaactgcaaatggtacagctggagtcaataactctggtgctgttcaggggcatttctttggtgcaaatgctgctgctttagcaggtatcgcgcaatttgataatgcttcttataacactgcatttggcggtgctaagaattaa

SEQ ID NO: 706 - protein, 263 aa, A. haemolyticus
MKISQLFIGLVACSAVFAHAGIEGASSNEANIKIGAAANASHPGGAAAVSVQAAGAPYNAFTGFSSLKGLAQAFAAQGTSNTNVTVGTKTFNISHIPVSAMPPSHSALGNFNFGQVGTQEVYFGEWWKAGDTPASASHTVYYAGDNTNTTVPTAGTATYTVAGINGSATNLLTGNFTANFGTGTLEGSLTGTGTAVSSLTLNGVAFNPGTAEFGGAATANGTAGVNNSGAVQGHFFGANAAALAGIAQFDNASYNTAFGGAKN

SEQ ID NO: 707 - DNA, 776 bp, A. minor
cgaaagcagaaaccttagcggaacaagcgaaagctcaacaagatgtagaaaaagcaaaagccgaattagcaaaattacaagaaaaacaactttatttggattctatttggcgttatttagggagagatgatcctagttctccccaacgagcaacagctggtagaagttcaatgaagatagatctttctcaatatccagaagaagatgagatgagagaagctgtcgttgttgatagtaataatgcaaaattaggaacggcatattttattaaccaagcctattctagttatgagcaatttgttcctgaaaatgtatcttttgatgcaccatatttctcaaacaatgattttgtatttatcccaactgatgtaacaaaatcttctaccattcaaaataaaatgacagctacctatagtggtttagctttagatcgtaattatcacaatgatgaagatcgtagcggttgggtaactaaagctaaattttctttaactgctgattttgctcaaaatacggtagaaggagctattactgaacgtgaaaacaaagcgcctgatattaagttagaacaaggagctattgcttcgtcagtaaccaatcaaaatatcaatatgccatatatgggatttagcggtaatgctacattaactagaaaaaatggttcggttagaacaggggaatatatcggcttctttgccggtcctgatgctgaagaagtggtaggttctgttaataaccttggaggacaaacatcttttggtggcaaacgccaataa

SEQ ID NO: 708 - protein, 257 aa, A. minor
KAETLAEQAKAQQDVEKAKAELAKLQEKQLYLDSIWRYLGRDDPSSPQRATAGRSSMKIDLSQYPEEDEMREAVVVDSNNAKLGTAYFINQAYSSYEQFVPENVSFDAPYFSNNDFVFIPTDVTKSSTIQNKMTATYSGLALDRNYHNDEDRSGWVTKAKFSLTADFAQNTVEGAITERENKAPDIKLEQGAIASSVTNQNINMPYMGFSGNATLTRKNGSVRTGEYIGFFAGPDAEEVVGSVNNLGGQTSFGGKRQ

SEQ ID NO: 709 - DNA, 1344 bp, A. minor
atgaaatttcaagttaagacaacagcattagcaattttagtttcttcaggtgtggtggggtgtaaatctaacgatacgcctaaccaagttgttgaaccaacaccggcaaatcaagcatcaaaaacagatgcggagaagaaagccgaagcagatgcaaaggcaaaagcaaccgctgaagcgaaagctaaagcagaagcagaggctaaagcaaaagctgaggaagcaaaacgtttagaagaagaacgtaaaaaggctgaagcagaagcgaaaaaattaacggatgccaaagcaaaagcggaagcagaagcgaaggcaaaagcagccgctgaagcgaaagctaaagcagaagctgcagagaaacttaaaccagtaaatctgttagataaaaatggagttgcatggcgaattattaatattcgtcaaaatggtccaagcaatgatacaacagaatatcgctatggtggtcgtaatagctcgttgagcagtgatttgtactacgtaggaaaacctgaaagcttttttgagctacttggagtcaatgcaataacgaatcttaatttcaatgaattaagtgagaaagatggcaagccattccttggagttcatcaagggaaaaaagaagatcctgatttcagcggaaaaattgtaactaaagttaaacgtgatggccatcttatcaaggttgctgaactagaggatgccaaagcatttaattatctctatgtaaatcaaccttattcgacttatggcgctctctttaccaacggacacgatgtgaaattcttctcagtggcacaaagcgcaggtaaagccggatattcccatatttatcctgtatggagagaggaagttgtggagcgtaacgggcaatctgttaaaaccggtaaaattatttggaatgatgcggtagccggagaggcaacttataaaggacaagtaattgcaagcgtaataaaatcggatatagagggttataacaggactggtatccgttctgaacctgtccttgatggtacggtaacattaaaagccaaatttgataaagatcctgagcgtaactctattgagggtgaaattgatagtaacctaataggtaaaatcgttttagagaaaaatcttgatcaatcggggacttttcgtctaggtagggcgacaaatgaaacgatgaacatcaaagaagcatctgggagaggcacgtacgaagttaagttctacggtaaagatttaaatgatgccgtaggaaaagtaaatttaaatagtgacgacgcatatactagatataaagaaactggcgatgtaattcaatacgacgccgtcttcggtgcaaccaaacaacctaaataa

SEQ ID NO: 710 - protein, 447 aa, A. minor
MKFQVKTTALAILVSSGVVGCKSNDTPNQVVEPTPANQASKTDAEKKAEADAKAKATAEAKAKAEAEAKAKAEEAKRLEEERKKAEAEAKKLTDAKAKAEAEAKAKAAAEAKAKAEAAEKLKPVNLLDKNGVAWRIINIRQNGPSNDTTEYRYGGRNSSLSSDLYYVGKPESFFELLGVNAITNLNFNELSEKDGKPFLGVHQGKKEDPDFSGKIVTKVKRDGHLIKVAELEDAKAFNYLYVNQPYSTYGALFTNGHDVKFFSVAQSAGKAGYSHIYPVWREEVVERNGQSVKTGKIIWNDAVAGEATYKGQVIASVIKSDIEGYNRTGIRSEPVLDGTVTLKAKFDKDPERNSIEGEIDSNLIGKIVLEKNLDQSGTFRLGRATNETMNIKEASGRGTYEVKFYGKDLNDAVGKVNLNSDDAYTRYKETGDVIQYDAVFGATKQPK

SEQ ID NO: 711 - DNA, 603 bp, A. minor
atgaaaaaattacttctttctgcaattttggctggattattaaccgcttgtagtggcggcggtggtggtagcggtacagcaacaacaccggataattctaacgttgatttaaccaacagcccgaaaggggatgtcggtgctaaaactactgatggagaactgtatggtcaaaacagcaatgactctttctatggtatttggttaaacgatagcaaaacgctaaaagaagttcgctatcaaggaacagcagcaacaaatttaccttctggtagcgcaacttacttaggcgatgcttattgggtaagtggcacaacaggacaaccatccaaaggtggtaaaactacattaaacgtagattttgatcagaaaacggtagatggtaaagttgaatttagcctattaaccgatggtcgtgcacaagatattaccttgcacaaaacccaattaaacggtaccactttcagcggcaaagcaaccaccctattacaggaaggcacttatgaaggtggcttgttcggtaatggagcaaaagaagcagcaggtattgcaactttcagtggtgataacagctacaatacttcattcggtggtattcgttactaa

SEQ ID NO: 712 - protein, 200 aa, A. minor
MKKLLLSAILAGLLTACSGGGGGSGTATTPDNSNVDLTNSPKGDVGAKTTDGELYGQNSNDSFYGIWLNDSKTLKEVRYQGTAATNLPSGSATYLGDAYWVSGTTGQPSKGGKTTLNVDFDQKTVDGKVEFSLLTDGRAQDITLHKTQLNGTTFSGKATTLLQEGTYEGGLFGNGAKEAAGIATFSGDNSYNTSFGGIRY

SEQ ID NO: 713 - DNA, 792 bp, A. oleivorans
atgaaaatctctcaattgttcttgggtctcgttgcttgttcaactgcatttgcttatgcaggaattgatggtatttcgagtaatgaaagtaacatcaaaatcggtgctgctgccaatgcaaaccatccgggtggtgtagcagcggtgtcggttcaagctgccggtgcaccatataacgcttttacaggttttagttcgttaaaaggtttggctcaggcttttgctgcgcagggaacgagtaataccaatgtaacggttggcagcaaaacctttaatatttcgcatattccagtgtctgcaatgccaccttcacacagtgccttaggtaattttaactttggtcaggtgggcacacaggaagtctattttggtgaatggtggaaagcgggcgacacaccggcaagcgcgagccataccgtttactacgcgggtgataacaccaataccacggttccaaccgcaggtactgcaacttataccgttgcagggattaatggttctggaagcaatctgttaagtggtacgttcacggcaaattatggcgcgggtacacttgaaggaacgcttaccggaacaggtacggctgtttcatcattaagcctagatggtgtggcatttaacccgggtactgctgcgtttgcaggtttggcaacggctaacggtacggctggtgtcgacaactctggtgtagttcaaggtcaattcttcggtgcaaatgcttcggctttagcgggtattgcccagtttgataacgtgtcttacaacactgcatttggcggtgctaaaaattaa

SEQ ID NO: 714 - protein, 263 aa, A. oleivorans
MKISQLFLGLVACSTAFAYAGIDGISSNESNIKIGAAANANHPGGVAAVSVQAAGAPYNAFTGFSSLKGLAQAFAAQGTSNTNVTVGSKTFNISHIPVSAMPPSHSALGNFNFGQVGTQEVYFGEWWKAGDTPASASHTVYYAGDNTNTTVPTAGTATYTVAGINGSGSNLLSGTFTANYGAGTLEGTLTGTGTAVSSLSLDGVAFNPGTAAFAGLATANGTAGVDNSGVVQGQFFGANASALAGIAQFDNVSYNTAFGGAKN

SEQ ID NO: 715 - DNA, 792 bp, A. pittii
atgaaaatctctcaattgttcttgggtctcgttgcttgttcaactgcatttgcttatgcaggaattgatggtatttcgagtaatgaaagtaacatcaaaatcggtgctgctgccaatgcaagccatccgggtggtgtagcagcggtgtcggttcaagctgcgggtgcaccatataacgcttttacaggttttagttcgttaaaaggtttggctcaggcttttgctgctcagggaacgagtaacaccaatgtaacggttggcagcaaaacctttaatatttcacatattccagtgtctgcaatgccaccttcacacagtgcattaggtaattttaactttggtcaggtgggcacacaggaagtctattttggtgaatggtggaaagcgggcgacacgccggcaagcgcgagccataccgtttactacgcgggtgataacaccaataccactgttccaaccgcgggtactgcaacctataccgttgcagggattaacggttctggaagcaatctgttaagtggtacgttcacggcaaattatggcgctggtacacttgaaggaacgcttacaggaactggtacggctgtttcatcattaagcctagatggtgtggcatttaacccaggtactgctgcgtttgcaggtttggcaacggctaatggtacggctggtgtcgacaactctggtgtagttcaaggtcaattcttcggtgcaaatgcttcggctttagcgggtattgcccagtttgataacgtgtcttacaacactgcatttggcggtgctaaaaattaa

SEQ ID NO: 716 - protein, 263 aa, A. pittii
MKISQLFLGLVACSTAFAYAGIDGISSNESNIKIGAAANASHPGGVAAVSVQAAGAPYNAFTGFSSLKGLAQAFAAQGTSNTNVTVGSKTFNISHIPVSAMPPSHSALGNFNFGQVGTQEVYFGEWWKAGDTPASASHTVYYAGDNTNTTVPTAGTATYTVAGINGSGSNLLSGTFTANYGAGTLEGTLTGTGTAVSSLSLDGVAFNPGTAAFAGLATANGTAGVDNSGVVQGQFFGANASALAGIAQFDNVSYNTAFGGAKN

SEQ ID NO: 717 - DNA, 1116 bp, A. pleuropneumoniae
gtgtacttagttggtctgccgccttattcttacggctggggacaggcttgcttctacgggtttcctttatggtatgtagatgtcggagccggaaatgtcgcacgtagcctcggttacgtgttttacgtcacagccgtactttgtaccacttacttaatcggcttattgttattaaccaaagccaaaccgtttctaagcgagtcctgtatcaaacttgttcgcgccaccatcttatgtgcgcttgccactttacctattttgattatcagcacgttacttaacggtaaaatttatcaacaagcggtaatttcttatttctgtgcggtactcttatttattatcgcattacgtaacgtgattaatcgccatatcagcaatatcaatatttattcggcaattcaatttttccaaagtcataaaagtaacgtactgatctttacttatgtgtatttcgtgatctttgcctttatggtcggttatttacgtccgcatttcaaaacacgcttcgatatgatcgaaattaatgcccaaatgtattatgtgctcgccaaatacaacaaaacctttatcttgtcgaaagaactaaaaatagataatgatgaattttatctgtatgaactaaatccgaatcagcttggtcatatccaaatcgtcgatgcgcatcatccgtttgggttacaggtggcatttgattctcacagccaaggaacacttacttataatgtagattttgctaagaaaacaggacaaggaagtattgaagggttagagcatataggtcgtttaacacttgatcaaggtgaaatttataaatcggcttcctctggcggtatgcgagcaagaggcagaattagtgcggatgaatggaaaaatgtaagagatactagtggagattaccaattaggattctatggtaaaaacgcagaagaaattgcggggcgagcaacattaagccaatctccttatggtgcttgggatagcgaaaagagcacttatttggcaccagttaaatctattagtgataaagtgctttctccagatagatacggtatgaattcaggtaaagattcatttgatgtcggctttggcggtacacgtggtgaaatcaaaaaatag

SEQ ID NO: 718 - protein, 371 aa, A. pleuropneumoniae
MYLVGLPPYSYGWGQACFYGFPLWYVDVGAGNVARSLGYVFYVTAVLCTTYLIGLLLLTKAKPFLSESCIKLVRATILCALATLPILIISTLLNGKIYQQAVISYFCAVLLFIIALRNVINRHISNINIYSAIQFFQSHKSNVLIFTYVYFVIFAFMVGYLRPHFKTRFDMIEINAQMYYVLAKYNKTFILSKELKIDNDEFYLYELNPNQLGHIQIVDAHHPFGLQMAFDSHSQGTLTYNVDFAKKTGQGSIEGLEHIGRLTLDQGEIYKSASSGGMRARGRISADEWKNVRDTSGDYQLGFYGKNAEEIAGRATLSQSPYGAWDSEKSTYLAPVKSISDKVLSPDRYGMNSGKDSFDVGFGGTRGEIKK

SEQ ID NO: 719 - DNA, 777 bp, A. segnis
atgaaaaactcaattgttaaattcactttaactacactagccgtgttaactttggctgcttgtggaagtggcggtggtgatagctcaccatcatcttcttctgtgaataatactcaaaaacaacaagcggaatctgttaaacctacagtaccgtcacagccgacgacaccagagaaaaaaaacgacttggtcatttcaggtcaggatgacaaagttcaagttaaaaatgttgtgcttactgattcaaatataaaggaattaagcattgatgggcgtagaattaaactagcttatcctggaatttatgcagatggttggcaaattgtaaatggtacaaacgtttgctgtggaaaatatgaaaatgttcgtattggtgctgttatgagccaaggccctggagaatctgatattatcttctacaatggcattccaacaaaaaatatgcctcagagcggttctgtgtcctacaaaggagatagcatcatttctggggctgatattaatgatgaagattatgtatctggaaaatctaactttactgtgaactttgatagcaaaaaacttagtggttctattaccgcaaattcaatgtctgcaattaacgtaaatgctgatatttcaggcaatagttttaaaggtacggctaaatcttcccaatttacttcagaaggtaaagttgaaggtaagttttatggaaataacgcggctgaattaggtggtttagctaaagggaatgacaattcctggggagctgcttttgctggtaagaaacagtaa

SEQ ID NO: 720 - protein, 258 aa, A. segnis
MKNSIVKFTLTTLAVLTLAACGSGGGDSSPSSSSVNNTQKQQAESVKPTVPSQPTTPEKKNDMVISGQDDKVQVKNVVLTDSNIKELSIDGRRIKLAYPGIYADGWQIVNGTNVCCGKYENVRIGAVMSQGPGESDIIFYNGIPTKNMPQSGSVSYKGDSIISGADINDEDYVSGKSNFTVNFDSKKLSGSITANSMSAINVNADISGNSFKGTAKSSQFTSEGKVEGKFYGNNAAELGGLAKGNDNSWGAAFAGKKQ

SEQ ID NO: 721 - DNA, 930 bp, A. succinogenes
atgagcaaatttacaaatgttgcgctggcgcttttaatgtcattggggatcggggcttgttcttcaagtaccggcgactcgtcatcaacctccggctccgttacggcatccactaccccgacaaatacctatactgcatcgacctcggaggatgattcggcgtcagacgctggcggttcgacttcaaacaatgacggttcggcgtcagacgatggcgactcgacttcggatgatacggctacgctaagtcaaattattgtaggtacaaatccaagcgcttcggattccgcatctgcagcctacaactatatcaacaatgatacggatacgttgctttccgcaattgcttccgtcggtacatcgacgctgagcgccagctgttcaagcagttccagcggcgcctgttcaagcgccaataaatctcagggggaggtaatgattgccaaaacccaaagctattcaagttatgcggtaattcgtgaagattataacgctgaagatgttccggctaactcttatgtcgcggtaaataccaatccgacatcggcggcgaatttatcatccgcattaaacgcgacttattcgggacaggcaacttatagcgtcaaaaatagagcgaatgcgttaacgcgcgattttactatgacggtaacggattcgactgtgagcggttctgtctacacaacggcaacgaacggaaacacgacgacttgggtaacgtttaatgacggaacgatttcggtcgataccggagcgattacatttagcggcaccgcaacatttaaagaaagcacttttggcgtaacggacggtacttaccaaggatcatttgccggtgaaaatgcggaagaagtggtgggtacgtttgaatctaacgaatcgacggattccggatcggtacaaggcgcatttgcagggactaaagactga

SEQ ID NO: 722 - protein, 309 aa, A. succinogenes
MSKFTNVALALLMSLGIGACSSSTGDSSSTSGSVTASTTPTNTYTASTSEDDSASDAGGSTSNNDGSASDDGDSTSDDTATLSQIIVGTNPSASDSASAAYNYINNDTDTLLSAIASVGTSTLSASCSSSSSGACSSANKSQGEVMIAKTQSYSSYAVIREDYNAEDVPANSYVAVNTNPTSAANLSSALNATYSGQATYSVKNRANALTRDFTMTVTDSTVSGSVYTTATNGNTTTWVTFNDGTISVDTGAITFSGTATFKESTFGVTDGTYQGSFAGENAEEVVGTFESNESTDSGSVQGAFAGTKD

SEQ ID NO: 723 - DNA, 600 bp, A. succinogenes
atgaaaaaatttattttttctacgttactggttgcttgtttaacggcatgtagtggtggcggaggtggcggcggtacggcagaaacaccggacggcactcggatcgatctttctcatagcccgaaaggtgacatcgtagccaagactacggatggtgagttttatggaaaaaatcacgatgattctttttatggtgtttggattaatgataccaaaacaataaaagaagttcgttatcaaggtacgccggcaacgaatttaccttcgggttcagcaacttatatcgggactgcatattgggtagacggtatcacaggtttgccttccaaaggcggcagaaccgtattaaatgcagatttttctcaaaaaaccattgatgggaaaattgaatttaatatgttaaatgatgggcggttacaagatattacattgcacaaaactcaattaaatggcgctaagtttgatggtgtcgcgactacaatatcacaaacaggtacctatgaaggcggattgttcggtaaagatgcaaaagaagcggcaggtattgccacatttaatgacagttcctataacacagcttttggcggtattcgttattag

SEQ ID NO: 724 - protein, 199 aa, A. succinogenes
MKKFIFSTLLVACLTACSGGGGGGGTAETPDGTRIDLSHSPKGDIVAKTTDGEFYGKNHDDSFYGVWINDTKTIKEVRYQGTPATNLPSGSATYIGTAYWVDGITGLPSKGGRTVLNADFSQKTIDGKIEFNMLNDGRLQDITLHKTQLNGAKFDGVATTISQTGTYEGGLFGKDAKEAAGIATFNDSSYNTAFGGIRY

SEQ ID NO: 725 - DNA, 1245 bp, A. suis
atgaaaaatattttaaataaacaagtattaaatacggcggcaacaattttattgtctatcggggtaacagcgtgttcatctgggggaagtgatcagcccggaattgatcaaagcactcgcttaagccaagtcgcggtacaacatttattagaagataaattacaagctcaagaacaccttgacgaggtaaaacaagcattggatgctctgcaattagctttagttaaagcacaagcggctaattcgacatcagatgtacaacaaacattaaaagatgctagtagcttattagaaaaagcgaaattggcagccgaaaatgctaaagatgaagcgaaaaatgctgcttcacgagtatcaagtgcaagtgcacaattatctaccgctgtagatgaagcgaataatgtaatgaacattgcgaatcaagcaaatagcgtgttattagaggcaactaacacctttaatcaaattcaatcagtgcttgctgatttaactcaaaaagaggtggcaaaagctgaagagcagacgaaaaaaatagcacaagaaaagcaaatagcgacaaataaagcgattaccactgcaatatcttataacaacctcgattcgattgtgcatgattatggtaatagcgaggcacgagaagcattattagcaaaattacaaaaacaaggctcaaatgcgccagcctcttgtagtaatgcaaaaacctcaacttgccataaagaggtagcaagaggcagtgtcgtagttaattacaatcaagcttattcaagttatgcggttattcgtgaaacctataataatgaaaatccacagccgagtaatgcttttattgtattagcgaaggagagcgatttaaccacagatcgtgctgcagtcgtaaatgcaacttatacgggtaaagcgtcttatagtgcaaaaaatgtgccggcggtaatgacgcgagatttcaccttaaaagtggaaaatgacaaagtaagtggttcggttttccaaaaaacgattaattcgaaggggatagaaaaagtaacagaaaatgtagcgttaaatgaaggaaagatcagtgttgataatggagtagtgggctttagtggctcagcaaaattcggtgcgatcgcaagcaatgccgaaggtacttataaaggcgtattcgtaggtaaaaatgcagaggaagtgatcggtacttttgaaacaaatagcacagaaaaagcttcttcagcacaaggtgcttttgcaggaaaaaaataa

SEQ ID NO: 726 - protein, 414 aa, A. suis
MKNILNKQVLNTAATILLSIGVTACSSGGSDQPGIDQSTRLSQVAVQHLLEDKLQAQEHLDEVKQALDALQLALVKAQAANSTSDVQQTLKDASSLLEKAKLAAENAKDEAKNAASRVSSASAQLSTAVDEANNVMNIANQANSVLLEATNTFNQIQSVLADLTQKEVAKAEEQTKKIAQEKQIATNKAITTAISYNNLDSIVHDYGNSEAREALLAKLQKQGSNAPASCSNAKTSTCHKEVARGSVVVNYNQAYSSYAVIRETYNNENPQPSNAFIVLAKESDLTTDRAAVVNATYTGKASYSAKNVPAVMTRDFTLKVENDKVSGSVFQKTINSKGIEKVTENVALNEGKISVDNGVVGFSGSAKFGAIASNAEGTYKGVFVGKNAEEVIGTFETNSTEKASSAQGAFAGKK

SEQ ID NO: 727 - DNA, 792 bp, Acinetobacter calcoaceticus NIPH 13
atgaaaatctctcaattgttcttgggtcttgttgcttgttcaactgcatttgcttatgcaggtattgatggtatttcgagtaatgaaagtaacatcaaaatcggtgctgctgccaatgcaagtcatccgggtggcgtagcagcggtatcggttcaagctgcgggtgcgccatataacgcttttacaggttttaattcgttaaaaggtttggctcaggcttttgctgctcagggaacgagtaacaccaatgtaacggttggcagcaaaacctttaatatttcgcatattccagtgtctgcaatgccaccttcacacagtgcattaggtaattttaattttggtcaggtgggcacacaggaagtctattttggtgaatggtggaaagcgggtgacacaccggcaagcgcgagccataccgtttactacgcgggtgataacaccaataccactgttccaaccgcgggtactgcaacctataccgttgcaggaattaacggctctgcaagcaatctgttaagtggtacgttcacggcgaactatggcgcgggcacacttgaaggaacgcttacaggaacaggtacggctgtttcatctttaagtctagatggtgtggcatttaacccgggcactgctgcgtttgcaggtttggcaacggctaacggtacggctggggtagataactctggtgtggttcaaggtcaattcttcggtgcaaatgcttcggctttagctggtattgcccagtttgataacgtgtcttacaacactgcttttggcggtgctaaaaattaa

SEQ ID NO: 728 - protein, 263 aa, Acinetobacter calcoaceticus NIPH 13
MKISQLFLGLVACSTAFAYAGIDGISSNESNIKIGAAANASHPGGVAAVSVQAAGAPYNAFTGFNSLKGLAQAFAAQGTSNTNVTVGSKTFNISHIPVSAMPPSHSALGNFNFGQVGTQEVYFGEWWKAGDTPASASHTVYYAGDNTNTTVPTAGTATYTVAGINGSASNLLSGTFTANYGAGTLEGTLTGTGTAVSSLSLDGVAFNPGTAAFAGLATANGTAGVDNSGVVQGQFFGANASALAGIAQFDNVSYNTAFGGAKN

SEQ ID NO: 729 - DNA, 792 bp, Acinetobacter sp. CIP 64.2
atgaaaatctctcaactgttcatcggtcttgttgcatgttctgctgtgtttgcacatgcaggtattgatggtgcttcaagtaatgaaaacaatatcattattggtgctgctgcaaatgccagccacccaggcggtgtagcagctgtttctgtacaagcggctggtgcaccatacaatgcatttacaggttttagctcgttaaaaggtttggcacaagcgttctctgcacgtggtgctagcaatactgatgttactgtcggtactaaaacttttaatatctcccatattcctgtttcggcaatgccaccttcacatagtgccttaggtaatttcaattttggtcaggtgggcacacaggaagtctattttggtgaatggtggaaagcgggcgatacagcagcaaatgcaagtcatactgtttattacgcaggtgacaataccaatacgacagtaccgacttctggtacggcgacttataccgttgcagggattaatggttcagcaaccaatctgttaagtggtaatttaactgctaactttggtgcaggcactttagaagggtcattaactggaacagggactgctgtttcaagcttaagcttggacggtgtgacatttaatccaggtactgcggcattcagtggcggtgcaagtgcaaatggtacggctgggctaaataattcaggtattgttcaaggacacttctttggtgcaaatgccgcagctttagcgggtattgccgagtttaataatgctgcttataacactgcatttggtggtgcgaaaaactaa

SEQ ID NO: 730 - protein, 263 aa, Acinetobacter sp. CIP 64.2
MKISQLFIGLVACSAVFAHAGIDGASSNENNIIIGAAANASHPGGVAAVSVQAAGAPYNAFTGFSSLKGLAQAFSARGASNTDVTVGTKTFNISHIPVSAMPPSHSALGNFNFGQVGTQEVYFGEWWKAGDTAANASHTVYYAGDNTNTTVPTSGTATYTVAGINGSATNLLSGNLTANFGAGTLEGSLTGTGTAVSSLSLDGVTFNPGTAAFSGGASANGTAGLNNSGIVQGHFFGANAAALAGIAEFNNAAYNTAFGGAKN

SEQ ID NO: 731 - DNA, 792 bp, Acinetobacter sp. CIP 70.18
atgaaaatctctcaactgttcatcggtcttgttgcatgttctgctgtgtttgcacatgcaggtattgatggtgcttcaagtaatgaaaacaatatcattattggtgctgctgcaaatgcaagccatccaggtggtgcagcagccgtttctgtacaagctgctggttcaccatataatgcatttacaggttttagctcgctaaaaggtttggcacaagcgttttctgcacgcggtacaagcaataccgatgttactgtcggtagcaaaacttttaatatctcgcatattcctgtttcggcaatgccgccttcacacagtgccttaggtaatttcaattttggtcaggtgggcacacaggaagtctattttggtgaatggtggaaagcaggcgatacagctgcgagcgcaagtcatactgtttattacgcaggtgacaataccaatacgacagtaccaacttctggtacggcgacctacaccgttgcagggattaatggttcagcaaccaatctgttaagcggtaatttgactgctaactttggtgcaggcactttacaagggtcattaactggaacagggactgctgtttcaagcttaagtttgaacggtgtgacatttagtccaggtactgctgaattcagtggcgcggcaagtgcaaatggtacagctggggtaaataattcaggtatcgttcaaggacacttctttggtgcaaatgctgcagctttagcgggtattgccgagtttaataatgtttcatataacactgcatttggtggtgcgaagaactaa

SEQ ID NO: 732 - protein, 263 aa, Acinetobacter sp. CIP 70.18
MKISQLFIGLVACSAVFAHAGIDGASSNENNIIIGAAANASHPGGAAAVSVQAAGSPYNAFTGFSSLKGLAQAFSARGTSNTDVTVGSKTFNISHIPVSAMPPSHSALGNFNFGQVGTQEVYFGEWWKAGDTAASASHTVYYAGDNTNTTVPTSGTATYTVAGINGSATNLLSGNLTANFGAGTLQGSLTGTGTAVSSLSLNGVTFSPGTAEFSGAASANGTAGVNNSGIVQGHFFGANAAALAGIAEFNNVSYNTAFGGAKN

SEQ ID NO: 733 - DNA, 792 bp, Acinetobacter sp. MN12
atgaaaatctctcaactgttcatcggtcttgttgcatgttctgctgtgtttgcacatgcaggtattgatggtgcttcaagtaatgaaaacaatatcattattggtgctgctgcaaatgcaagccatctaggtggtgcagcagccgtttctgtacaagctgctggttcaccatacaatgcatttacaggttttagctcgctaaaaggtttggcacaagcgttttctgcacgcggtacaagcaataccgatgttactgtcggtagcaaaacttttaatatctcccatattcctgtttcggcaatgccgccttcacacagtgccttaggtaatttcaattttggtcaggtgggcacacaggaagtctattttggtgaatggtggaaagcaggcgatacagcagcgagcgcaagtcatactgtttattacgcaggtgacaataccaatacgacagtaccaacctcaggtacggcgacctataccgttgcagggattaatggttcagcaaccaatctgttaagcggtaatttgactgctaactttggtgcaggcactttacaagggtcattaactggaacagggactgctgtttcaagcttaagtttgaacggtgtgacatttagtccaggtactgctgaattcagtggcgcggcaagtgcaaatggtacagctggggtgaataattcaggtattgttcaaggacacttctttggtgcaaatgctgcagctttagcgggtatcgccgagtttaataatgtttcatataacactgcatttggtggtgcgaagaactaa

SEQ ID NO: 734 - protein, 263 aa, Acinetobacter sp. MN12
MKISQLFIGLVACSAVFAHAGIDGASSNENNIIIGAAANASHLGGAAAVSVQAAGSPYNAFTGFSSLKGLAQAFSARGTSNTDVTVGSKTFNISHIPVSAMPPSHSALGNFNFGQVGTQEVYFGEWWKAGDTAASASHTVYYAGDNTNTTVPTSGTATYTVAGINGSATNLLSGNLTANFGAGTLQGSLTGTGTAVSSLSLNGVTFSPGTAEFSGAASANGTAGVNNSGIVQGHFFGANAAALAGIAEFNNVSYNTAFGGAKN

SEQ ID NO: 735 - DNA, 792 bp, Acinetobacter sp. NIPH 1859
atgaaaatctctcaactgttcatcggtcttgttgcatgttctgctgtgtttgcacatgcaggtattgatggtgcttcaagtaatgaaaacaatatcattattggtgctgctgcaaatgccagccacccaggcggtgcagcagctgtttctgtacaagcggctggtgcaccatacaatgcatttacaggttttagctcgttaaaaggtttggcacaagcgttctctgcacgtggtgctagcaatactgatgttactgtcggtactaaaacttttaatatctcccatattcctgtttcggcaatgccaccttcacatagtgccttaggtaatttcaattttggtcaggtgggtacacaggaagtctattttggtgaatggtggaaagcgggcgatacagcagcaagtgcaagtcatactgtttattacgcaggtgacaataccaatacgacagtaccgacttctggtacggcgacttataccgttgcagggattaatggttcagcaaccaatctgttaagtggtaatttaactgctaactttggtgcaggcactttagaagggtcattaactggaacagggactgctgtttcaagcttaagcttggacggtgtgacatttaatccaggtactgcggcattcagtggcggtgcaagtgcaaatggtacggctgggctaaataattcaggtattgttcaaggacacttctttggtgcaaatgccgcagctttagcgggtattgccgagtttaataatgctgcttataacactgcatttggtggtgcgaaaaactaa

SEQ ID NO: 736 - protein, 263 aa, Acinetobacter sp. NIPH 1859
MKISQLFIGLVACSAVFAHAGIDGASSNENNIIIGAAANASHPGGAAAVSVQAAGAPYNAFTGFSSLKGLAQAFSARGASNTDVTVGTKTFNISHIPVSAMPPSHSALGNFNFGQVGTQEVYFGEWWKAGDTAASASHTVYYAGDNTNTTVPTSGTATYTVAGINGSATNLLSGNLTANFGAGTLEGSLTGTGTAVSSLSLDGVTFNPGTAAFSGGASANGTAGLNNSGIVQGHFFGANAAALAGIAEFNNAAYNTAFGGAKN

SEQ ID NO: 737 - DNA, 792 bp, Acinetobacter sp. NIPH 1867
atgaaaatctctcaactgttcatcggtctcgttgcatgttctgctgtatttgctcatgcaggtattgaaggtgcttctagcaatgaagcaaatatcaaagtcggtgcggcagcaagtaccagtcatccgggtggtgcagcagcagtttctgtgcaggctgcaggtgcgccatataacgcttttacaggctttagttcactaaaaggtttagcgcaagcattttctgcacaaggcacaagtaatactaatgtcactgtaggtaccaagacatttaatatctcccatattcctgtatctgcaatgccgccttcacacagtgctttaggtaattttaattttggtcaagtcggcacacaggaagtttatttcggtgaatggtggaaagcaggcgatacacctgcaagcgcaagccatacggtttattacgcgggtgacaataccaataccacagtaccaactgcaggtactgcaacatataccgttgcagggattaatggctcagcaactaatctgctaagtggtaatttcacagcgaactttggtgcaggtactttagaaggctcattagctggaacaggtacaaccgtttcaaacgtaacacttgatggtgtgacgtttaatccaggttcagctgcatttagtggatttgcaattgcaaatggtacagctggcttaaatgactcaggtattgttcaggggcatttctttggtgcaaatgcggctgctttagcgggtatcgcgaaatttgacaatgtttcttataacactgcatttggcggtgcgaagaactaa

SEQ ID NO: 738 - protein, 263 aa, Acinetobacter sp. NIPH 1867
MKISQLFIGLVACSAVFAHAGIEGASSNEANIKVGAAASTSHPGGAAAVSVQAAGAPYNAFTGFSSLKGLAQAFSAQGTSNTNVTVGTKTFNISHIPVSAMPPSHSALGNFNFGQVGTQEVYFGEWWKAGDTPASASHTVYYAGDNTNTTVPTAGTATYTVAGINGSATNLLSGNFTANFGAGTLEGSLAGTGTTVSNVTLDGVTFNPGSAAFSGFAIANGTAGLNDSGIVQGHFFGANAAALAGIAKFDNVSYNTAFGGAKN

SEQ ID NO: 739 - DNA, 792 bp, Acinetobacter sp. NIPH 809
atgaaaatctctcaactgtttatcggtcttgttgcatgttctgctgtgtttgcacatgcaggtattgatggtgcttcaagtaatgaaaacaatatcattattggcgctgctgcaaatgctagccacccaggtggtgcagcagccgtttctgtacaagcggctggtgcaccctacaatgcatttacaggttttagctcgttaaaaggtttggcacaagcgttcactgcacgtggtgcaagcaatactgatgttactgtcggtagcaaaacttttaatatctcccatattcctgtttcggcaatgccaccttcacatagtgccttaggtaatttcaattttggtcaggtgggcacacaggaagtctattttggtgaatggtggaaagcgggcgatacagcagcaagtgcaagtcatactgtttattacgcaggtgacaataccaataccacagtaccgactgctggtacggctacctataccgttgcagggattaatggttcagcaaccaatctgttaagtggtaatttaactgctaactttggtgcaggcactttagaagggtcattaactggaacagggactgctgtttcaagcttaagcttgaacggtgtgacatttaatccaggtactgcggcattcagtggcggtgcaagtgcaaatggtacggctgggctaaataattcaggtattgttcaaggacatttctttggtgcaaatgctgcagctttagcgggtattgccgagtttaataatgctgcttataacactgcctttggtggtgcgaaaaactaa

SEQ ID NO: 740 - protein, 263 aa, Acinetobacter sp. NIPH 809
MKISQLFIGLVACSAVFAHAGIDGASSNENNIIIGAAANASHPGGAAAVSVQAAGAPYNAFTGFSSLKGLAQAFTARGASNTDVTVGSKTFNISHIPVSAMPPSHSALGNFNFGQVGTQEVYFGEWWKAGDTAASASHTVYYAGDNTNTTVPTAGTATYTVAGINGSATNLLSGNLTANFGAGTLEGSLTGTGTAVSSLSLNGVTFNPGTAAFSGGASANGTAGLNNSGIVQGHFFGANAAALAGIAEFNNAAYNTAFGGAKN

SEQ ID NO: 741 - DNA, 792 bp, Acinetobacter sp. WC-323
atgaaaatctctcaactgttcatcgctctggttgcatgttctgcggtattcagccatgcagcaattgaaggcgcttcaagcaacgaagcaaatatcaaagtcggtgcggcagcaaatgccagtcatagcggtggaacagctgctgtttcagtagaggcggcaggtgcaccttataatgcattcaccggttttagttcactcaaaggtctagcgcaagcatttgctgcacaaggaaccagcaatagcaatgtaactgtgggtagcaagagctttaatatctctcacattcctgcctctgcaatgccgccttcacatagcgctttaggtaattttaactttggacaggtcggcacacaggaagtttatttcggtgaatggtggaaagccggtgatacgcctgccagcgcaagccatacggtttattacgcaggtgacaataccaataccacagtacctactgcaggaacggcaacctataccgttgcagggattaatggctcggcagccaatctgttaactggtaatttcactgcaaacttcggtgcaggcacgctcgaaggatcattaaccggaaccggcactagcgtttcaaacttaacactggatggtgtgacctttaatccgggttcggctgcatttagcggttttgcaattgcaaatggtaccgctggcttaaatgactccggagcggttcagggacatttctttggcgcaaatgcggctgctttagcgggtatcgcgaaatttgacaatgtgtcttataacacggcatttggcggtgcgaaaaactaa

SEQ ID NO: 742 - protein, 263 aa, Acinetobacter sp. WC-323
MKISQLFIALVACSAVFSHAAIEGASSNEANIKVGAAANASHSGGTAAVSVEAAGAPYNAFTGFSSLKGLAQAFAAQGTSNSNVTVGSKSFNISHIPASAMPPSHSALGNFNFGQVGTQEVYFGEWWKAGDTPASASHTVYYAGDNTNTTVPTAGTATYTVAGINGSAANLLTGNFTANFGAGTLEGSLTGTGTSVSNLTLDGVTFNPGSAAFSGFAIANGTAGLNDSGAVQGHFFGANAAALAGIAKFDNVSYNTAFGGAKN

SEQ ID NO: 743 - DNA, 792 bp, Aggregatibacter sp. oral taxon 458
atgaaaaattcaattgttaagtttagtttaacggtattagccgcattcacattagccgcttgcggaagcagtggcggtagcagtgataatgccgctgcggcaagccatgatcaaaaaactcaggtaacgccatctaaaaccgatctgccaacatcgaattcaactgaggtaaatcaaaatcaaacatttacaggttcagcttttgttttctctgaacaagatgacaaatttcaagtcaaaaaaaatgttaaatttaacgacgcaaatataaatcaattagaggttgatggacacaagataacgcttacttaccccgaaggtaacgggcaagatttagatgatgcagtagtatgttgtgataagtatgccaatgtccgtatgggggtatctttaagtaatggtccggatgaggacgatattctgttctataatggcattccaaccccaaatatgcctgtaaccggtttggcgtcgtataaaggcgatggcattattttgttcaatgatattggcgatgattctgatgaggatacggtagaaggtcaatcttcttttgatgttaattttggtgcgaagacgctaagcggttctattacagctaacaatgtaccaaccattaatattagtgcgaatatttccggtaatagctttgagggtacggctaaatcgacaaaattgactgatggcgcagttgaaggtaagttttatggcaataatgcggtagaattaggcggcttggcaaaagcaaatgataattcatggggcgccggttttgtcggtaagaaacagtaa

SEQ ID NO: 744 - protein, 263 aa, Aggregatibacter sp. oral taxon 458
MKNSIVKFSLTVLAAFTLAACGSSGGSSDNAAAASHDQKTQVTPSKTDLPTSNSTEVNQNQTFTGSAFVFSEQDDKFQVKKNVKFNDANINQLEVDGHKITLTYPEGNGQDLDDAVVCCDKYANVRMGVSLSNGPDEDDILFYNGIPTPNMPVTGLASYKGDGIILFNDIGDDSDEDTVEGQSSFDVNFGAKTLSGSITANNVPTINISANISGNSFEGTAKSTKLTDGAVEGKFYGNNAVELGGLAKANDNSWGAGFVGKKQ

SEQ ID NO: 745 - DNA, 618 bp, Aggregatibacter sp. oral taxon 458
atgttaaaacaacttaaatacacgtctattttggctttatctgcattagctgttgcttgttccggtggtgatagcggggcgggtacagcagaaacaccggatgggaacaaatttaacttaacaaatagtactaaagggttggttgggagtaaaacaatggatggtaaactcatcggctataaccaaaatcactctttttacggtgtgtgggtgaataatgataaaactcgccaacaggttcgttatcaaggaactgccacaccaacagatcgtttgccaagaggagctgcaacttatacaggacatgccgttcgtgcgcgcgatagcgttattgcgcaaaatattaatggtgttcaagctgatggaacaatgacattacatgtgaattttgatacgaaaaaggtttccggaaagttgggtattccttgggctcgcgatattaccttgcatgaaaccgatttaaatggtaaccaatttgccggcaaagccagcgtgttattcaatgatggcggtcgttataaaggcggattgtttggcccgaatgcagaggaagctgccggtatggccacgtttgataacaatccaagtttaaatacttcctttggtggttaccgttaa

SEQ ID NO: 746 - protein, 205 aa, Aggregatibacter sp. oral taxon 458
MLKQLKYTSILALSALAVACSGGDSGAGTAETPDGNKFNLTNSTKGLVGSKTMDGKLIGYNQNHSFYGVWVNNDKTRQQVRYQGTATPTDRLPRGAATYTGHAVRARDSVIAQNINGVQADGTMTLHVNFDTKKVSGKLGIPWARDITLHETDLNGNQFAGKASVLFNDGGRYKGGLFGPNAEEAAGMATFDNNPSLNTSFGGYR

SEQ ID NO: 747 - DNA, 1545 bp, Aggregatibacter sp. oral taxon 458
atgaactttaaaaatacaaccattgcagcagcaattttattttcccttactgcctgtggaagcagtagtggcggctctaacacggttgataacaaaccaacggctaaaaatgaacaaacccaacaacaagtagcagacgcaaaaaaagcggaagaaacacgtcaagctgaaaaagctcgtaaagccgaagaagctcgtcaagctgaagaagcacgtaaagctgaagaagctcgtaaagctgaaggagctcgtcaagctgaagaagcacgcaaagctgaagaagcgcgtcaagccgaagaagcacgcaaagctgaagaagctcgtaaagctgaagaagctcgtaaagccgaagaagcacgtcaagccgaagaagcacgtaaagctgaagaagctcgtcaagccgaagaagcacgcaaagctgaagaagctcgtaaagctgaagaaacgcgtcaagccgaagaagcacgcaaagctgaagaagctcgtaaagccgaagaagctcgtcaagccgaagaagcacgcaaagctgaagaagctcgtaaagctgaagaagtacgcaaagctgaagaagcacgtaaagcagaagaaactcgtcaagctgaagaagcacgtaaagcagaagaagcacgcaaagctgaagaagctcgtaaagaagctgaagaagctcgtcaagccgaagaagcacgtaaagccgaagaggctcgtattgcacaaaaaactgctgagttaattgaacaagctaaagctaaagggctaaacgatgacgaagcaaaacaatttgcgcaaaataatatcaataatgaagatgatgtatctaaagcaaatttagataacatgattaaaataaaagatttgacaaaacttgctattgctgaaggtcttaatgaacatcaagccgctgattttgctaaaaataatgtagatttagatgaagatacagcaaaagctaaccttgaaacacttatcatcaataatgctaaaggaatttataatggacaatatcgtaatgggctaactacaaaccaatatggcacatcaagtagttcctcatctggttgtacaaatggacgttgctattcagtagaagaaactattactaccggtaaagcaatctataaccaaccatattcaattattgttgccaatacaaaatcaggtgttcgtaattattctcctattaatgaactatcgaatgtacaaattactggtctaaaaacaaaattagacgcgataccaacggaaggaacagctaattatagtggtaaagcatttgatgccaaaaataatggagcactagattacaatgttaattttgcaaataaaacaggctcaggaactattaccggcttaggaaataacattacattagaacagggttctatttcaggctctggtatttcatctagtgcaacccaaggttacaaatcaggttcttattctttagatttctttggtaaaaatgcggaagaaattggcggtaaagtcactcttgatggaaaagatgcagtcggcttcggtggtacacgtggcgaaatccagaaataa

SEQ ID NO: 748 - protein, 513 aa, Aggregatibacter sp. oral taxon 458
MNFKNTTIAAAILFSLTACGSSSGGSNTVDNKPTAKNEQTQQQVADAKKAEETRQAEKARKAEEARQAEEARKAEEARKAEGARQAEEARKAEEARQAEEARKAEEARKAEEARKAEEARQAEEARKAEEARQAEEARKAEEARKAEETRQAEEARKAEEARKAEEARQAEEARKAEEARKAEEVRKAEEARKAEETRQAEEARKAEEARKAEEARKAEEARQAEEARKAEEARIAQKTAELIEQAKAKGLNDDEAKQFAQNNINNEDDVSKANLDNMIKIKDLTKLAIAEGLNEHQAADFAKNNVDLDEDTAKANLETLIINNAKGIYNGQYRNGLTTNQYGTSSSSSSGCTNGRCYSVEETITTGKAIYNQPYSIIVANTKSGVRNYSPINELSNVQITGLKTKLDAIPTEGTANYSGKAFDAKNNGALDYNVNFANKTGSGTITGLGNNITLEQGSISGSGISSSATQGYKSGSYSLDFFGKNAEEIGGKVTLDGKDAVGFGGTRGEIQK

SEQ ID NO: 749 - DNA, 1719 bp, B. psittacipulmonis
atgtttcaaaaatacaccatcacttatctcatcactgcaatcctgttaactgcttgttcgactagcggcggaacctttgatcctttagatgtaggtagtagtacaaaatctggactaccggatagtgcgaacaatgtgaaatacgtcaatcccgtgattgaaaccgacccagaagcacaatctatcgatgaaacgggatacagcattaatgtgccaattcctaaagccctatatgaaaattatgcaaagagatacttcaaccccaatacattaaaaatcaacaaagatcataattatttagatactagcgatcaatacgaaacattgacattaaagattgtaagtctgaacgaaaacggaaccccaatcatttctgagagaaaaattccattcaaaatcacagaagacacttggaattatcttgataatactataaaagaatcagacgaaaacaatatcaacacataccatgataggacctacaatccttatttaaagatttataaattaaataattcactagtcggaaccattatatttacgaatttaaaagatagttcacttaatatcaataatgtagctgaagaaaacaaatccgttcaattattctacaagggtcatataaaaccaaccgtagaaaatatgccgatttcgggaacgtttggatataatggaaaatggttttttgtcactcaagtaaataatttatctcaggatactgatgcagaatggggaaaatactcctcctcactccccctttctttaaccatcgactttacccagaaaacagtaaaaggaaatctatcacattcaggagataacgtaacgataaattacactattgatgccgtcattaaagggaattactttaaaggggttgcaaagggaaaatacgaatccacaggaaactcccttaacggctcaagtgaagccgatgcggatttgatcggttctttctttggagacactgcagaagaagctgctggacgtgtcatcgctagagatttctcatggggtgcggtttttgccacgaaacgacaaagaaatgatctcagtgatttagcggctgcgggtattttaggctttgatcacaacggtaccttacaagactatcaagccaatatcgcaacacaaactctcgatcgattaatcgttgacggagaaatcattgatttctcacaagaatataatgaactatgttgtgccgaaacaaaatttgtgaaatatggcacattcaagccagaaaacagtaacaacattcaaggtggttattttattcaaggcacagccacaaccgatatgcctgaaacggggaatgccagctatcgtggaaactggtatggttttgttaaagatagtagcacaggatactcagcaactgcacaaaaaaatgaagcgacttatcaagcgaattggggagataaaaccctatcgggcaaactatttggcaaaaatcaagatattaacagcgatcaaccaatcggtatcttatctgccaaaattcaagataacacgtttcagggcaaggtgacctttaaagattgggcagtcgatgaaaacaaagacaacttagagaacactcaaaaaatcagtggtgaagcagaagccaagggatatttttatggtgctaaagccaatgagttaggtgggcattttaaaaatcaagacaattcagcaggaggtgtatttggcggtaaacaaatcgaagtaaccccctaa

SEQ ID NO: 750 - protein, 572 aa, B. psittacipulmonis
MFQKYTITYLITAILLTACSTSGGTFDPLDVGSSTKSGLPDSANNVKYVNPVIETDPEAQSIDETGYSINVPIPKALYENYAKRYFNPNTLKINKDHNYLDTSDQYETLTLKIVSLNENGTPIISERKIPFKITEDTWNYLDNTIKESDENNINTYHDRTYNPYLKIYKLNNSLVGTIIFTNLKDSSLNINNVAEENKSVQLFYKGHIKPTVENMPISGTFGYNGKWFFVTQVNNLSQDTDAEWGKYSSSLPLSLTIDFTQKTVKGNLSHSGDNVTINYTIDAVIKGNYFKGVAKGKYESTGNSLNGSSEADADLIGSFFGDTAEEAAGRVIARDFSWGAVFATKRQRNDLSDLAAAGILGFDHNGTLQDYQANIATQTLDRLIVDGEIIDFSQEYNELCCAETKFVKYGTFKPENSNNIQGGYFIQGTATTDMPETGNASYRGNWYGFVKDSSTGYSATAQKNEATYQANWGDKTLSGKLFGKNQDINSDQPIGILSAKIQDNTFQGKVTFKDWAVDENKDNLENTQKISGEAEAKGYFYGAKANELGGHFKNQDNSAGGVFGGKQIEVTP

SEQ ID NO: 751 - DNA, 1338 bp, B. psittacipulmonis
atgagaagcttaggagttattttatttgtggcgttattgaccgcttgctcaagcagttctgggaataaatcgtcaaatttagttgttcatccgaatattcctgtaacagaatctcccagcacaggtggttcaagtggtgaaaattccgagggatcgcaagttaacggttcagatcagggggatagcatcgagtcacagccggataacagtggaacaggtgcttcaggttctggatcgagtgatggcacaaaacaggatggtgcagggtcatcaacgggtgataatggaaattcagaaaatgctcaagaagtagataatggagcggctgtggcagatggcgatgcttccagcgatagtaagaatagtgattttcatcctcctacagagaaagaaggcgatgataatacttttgatgctaccgatattgaagcaggaggaaataatgagactacagaagaggttcgtgttgctgataaggaagctgaaaaaaacgctgccgctcctttgcacaaatatgctccacccaccaaagaggcgattaaagagtggctaacaacacctgtcactgagggtgggttaggcgtagagaatgcagatgatgtagcgtattatttagatgagggaaaagtaggacgtgatgcattctttcaagctaataagggaaatgcagagaaacaaggctttcaaacggctcaaaaacgttggatacggtcatcagatagtcaccgtatttattatgatcaggaaaatgctccacttttgtacaatcaaaattactcaatgattgaaggtgccttggttactcatcttgttggggatgggtctggcctgatagatgattttatgattctagaaaaaggtcagtttacgagtcgggatgaattgaagtctctttcaggtaaggtgacttatacaggtaaagcttttgataaagatacgcaagttgtagttgtaagaactgactcaggaagtgactcctactccgttttaggatcaggtacatttacttacactattgattttgataaaaataaaggtagcggtaagattactgatatgtcatcatatggtgatattatcttaaaggaagtgaatttggctcctggtcagaaaaaccttctaactggtgaaagctattatggtgcgggctatcagacaggtaatgatagtagaggtgaggttactttcgctaatggcgttgacgataagacctataagtatagcattgctttatatggttatgatggagaagaagtgttaggcaaagttcaagaagtagaagaaggtaagggcattggcaaggatgtcattggttttggtggtaagaagcagcagtaa

SEQ ID NO: 752 - protein, 445 aa, B. psittacipulmonis
MRSLGVILFVALLTACSSSSGNKSSNLVVHPNIPVTESPSTGGSSGENSEGSQVNGSDQGDSIESQPDNSGTGASGSGSSDGTKQDGAGSSTGDNGNSENAQEVDNGAAVADGDASSDSKNSDFHPPTEKEGDDNTFDATDIEAGGNNETTEEVRVADKEAEKNAAAPLHKYAPPTKEAIKEWLTTPVTEGGLGVENADDVAYYLDEGKVGRDAFFQANKGNAEKQGFQTAQKRWIRSSDSHRIYYDQENAPLLYNQNYSMIEGALVTHLVGDGSGLIDDFMILEKGQFTSRDELKSLSGKVTYTGKAFDKDTQVVVVRTDSGSDSYSVLGSGTFTYTIDFDKNKGSGKITDMSSYGDIILKEVNLAPGQKNLLTGESYYGAGYQTGNDSRGEVTFANGVDDKTYKYSIALYGYDGEEVLGKVQEVEEGKGIGKDVIGFGGKKQQ

SEQ ID NO: 753 - DNA, 1017 bp, B. trehalosi
atgaaaagacagtttgtcaatggtgcaatggcactcttaatcgcattaggtgtatcggcatgttctgtgaatgctggcagtggtagtcaaggtgatcctgttattcgagcaacgagtagtgcaacaaatacaaacactaatgagaattcggataccgaaacgagtgaagataatacattagtagaagagcgtgcggaaagtacaacggagagttcatcaacagagggcagctcgaaagatacgactacagatgagcccagccatacaactacggaaaatgttgtagataatatcgacaatgaagacgatgaatcggaattaattgcgattggtggggttggcgtaatgggtagtcaggcagagaaatacttaacttctttaagtgcacaggatgaactttttgcctcaatcaacaaaatggagaatgttgctactggcagttgctcaaattcagctgcttctggttcaaaatgtgccgtagcgaatgctcaagaaggtgatattctcgctgtttatacgctaaaagataacgcagctcaaacactggctggctatgcggttattcgtgaagcttatactagccgtgaaaatccaaccaatagctatatcacgttattatctgtcccaaccacggaaaagtcagccgtggttaatgcgacttatacggggaaagcttcactttcttataacaatagtgctgctatcaatacgatggagtttgaaatgacagcaagcaatgacacagtaagtggcaaaatttatacgatagcaaatacaggtaaagaatctgtccgtgttacgctcaacagtggcgatattaatgtgactaacggattagttgggtttaatggtacaacaacctttaataaaacagcatatgctgatttggctgatgtagaaggtgtttatcagggttggtttgttggtgaaaatgcagaaggtgtgatcggcactattcatactaagaatcagactacttcaggcgtgcttcaaggtgcatttgcagggacaaaataa

SEQ ID NO: 754 - protein, 338 aa, B. trehalosi
MKRQFVNGAMALLIALGVSACSVNAGSGSQGDPVIRATSSATNTNTNENSDTETSEDNTLVEERAESTTESSSTEGSSKDTTTDEPSHTTTENVVDNIDNEDDESELIAIGGVGVMGSQAEKYLTSLSAQDELFASINKMENVATGSCSNSAASGSKCAVANAQEGDILAVYTLKDNAAQTLAGYAVIREAYTSRENPTNSYITLLSVPTTEKSAVVNATYTGKASLSYNNSAAINTMEFEMTASNDTVSGKIYTIANTGKESVRVTLNSGDINVTNGLVGFNGTTTFNKTAYADLADVEGVYQGWFVGENAEGVIGTIHTKNQTTSGVLQGAFAGTK

SEQ ID NO: 755 - DNA, 1290 bp, B. trehalosi
atgaaaaaaactgtcacgaatactgctattgctctgctactttctttaggtgttgcggcttgtggctctcgacataaagagactattgtgaacacgacaccgaatacatcagcggcagagctatctatcgtaaaacagcaattggcagatgctcaacgtgcgttagctacggctgaaaccgcagcagctgaagccaaagaggctcaaacaaccgtagaaaacacattacaagcggtacaaattgaggcagaaacggcaaaatctacagcagcggtggcacaaacccagctgacagccgcacagcaagagattgagaatttaaaagcacggcttgcgagcagttccgattctacagaagttgaggcgcttaaagcagcacttgcagcggcagagcagaaagctgctcaagcagaaaccgagcttgtgagtgcgaattccgcactagaaaaagccaatagtgagcttgctgcaacagaaagtcaattagccaactatgttgcaaaagagaaagttgctggcgataaaattgcttcagatttgacagctggtggttttgcagcagatagcacctcttatacttacgcatatctgaacgacgaagtaaaaaaagcagaattagcagaagtgattgcaaacggcacagcgagttgcggttctgcagcaagccctgtgactggtgcagctgttgcggggtgtttaagattatcaaatactgcagagggtacgattttatttacaaaagagaatgaatattctgcttatgctgttgtgcgtgaagcctatgatgcagatagtggtgtgaatatgccgaaaaattcttttatcgctctggttaaaacaccaacaactgataaagctcaggtattgggagcaacttatcgtggtttagcaacttattctcaaagtgcaggtttaaatggctcttctcttgtgggtgagaacattgctgctacggcaggaaaattgaatgtcgttactttaaatgtggatcaaaatgggcaaattagtggcgaaatttggaataaaaccagtgcgaaagaagagaatcattaccgtacggttgaactaaaggcggcagatgtcttagtcagcaacagtggtatcgtgtttgaaggtgaggccgccattaatgaaaaaatgctcaagacagggactccgttagaaggaacttataaaggtgcatttgcagggaatgaaggtcaagaagtagtgggaacattccaaacaaactcgcttgaaacaaattatgtgcaaggtgcatttagtgcaaccaaagatagtgcagagtaa

SEQ ID NO: 756 - protein, 429 aa, B. trehalosi
MKKTVTNTAIALLLSLGVAACGSRHKETIVNTTPNTSAAELSIVKQQLADAQRALATAETAAAEAKEAQTTVENTLQAVQIEAETAKSTAAVAQTQLTAAQQEIENLKARLASSSDSTEVEALKAALAAAEQKAAQAETELVSANSALEKANSELAATESQLANYVAKEKVAGDKIASDLTAGGFAADSTSYTYAYLNDEVKKAELAEVIANGTASCGSAASPVTGAAVAGCLRLSNTAEGTILFTKENEYSAYAVVREAYDADSGVNMPKNSFIALVKTPTTDKAQVLGATYRGLATYSQSAGLNGSSLVGENIAATAGKLNVVTLNVDQNGQISGEIWNKTSAKEENHYRTVELKAADVLVSNSGIVFEGEAAINEKMLKTGTPLEGTYKGAFAGNEGQEVVGTFQTNSLETNYVQGAFSATKDSAE

SEQ ID NO: 757 - DNA, 618 bp, B. trehalosi
atgcaacgtcattttcttaaatctttatttgcaacagcagtcatcgtcggtttaactgcttgtggttctagcggtggtggttcaggctctgctacaacccctgatggtgatacaatcaatttatcaggtagcccacaaggtacaattacagcagatactacctatggcaacttaacagggcaaaataacccaaattcattctatggggtatggcaacacaatagtggctcactctatgaattgcgttatcaaggtacagaagcaaccaatattccgacttctggtaaagcaacttatgttggtgatgctatttggttaggttcactttctaattcttatcgtcaaggtggaacaactacattaaatgtagattttgggcaaaaaaccgtagatggcaaaattgcatttagtttgttaaatgatggtcgttctcgtgatattacgcttcaccaaaccacacttaatgggacgaaatttagcggacaagccagtgtgttattaaatagcagtggtacttacgaaggggctttattcggaaatggggcaactgaagcagcagggctggttaattttgctaatgatagttctcttgatgttagctttggcggtaaacgttaa

SEQ ID NO: 758 - protein, 205 aa, B. trehalosi
MQRHFLKSLFATAVIVGLTACGSSGGGSGSATTPDGDTINLSGSPQGTITADTTYGNLTGQNNPNSFYGVWQHNSGSLYELRYQGTEATNIPTSGKATYVGDAIWLGSLSNSYRQGGTTTLNVDFGQKTVDGKIAFSLLNDGRSRDITLHQTTLNGTKFSGQASVLLNSSGTYEGALFGNGATEAAGLVNFANDSSLDVSFGGKR

SEQ ID NO: 759 - DNA, 897 bp, B. trehalosi
atgtctatcaaaaaagtaactttagccagtttgattttattgagtttaaccgcgtgtagtagtggtggttcgggcggaagctcaaacaatgtggaaaagcagaatactaacccacagacgacacagcaacaaaccgataaagcggctaaagaaaaggcggaagcagagcgtttagcagcagaaaaagcagctaaagagaaagccgaagcggaacgtttagcggcagagaaagcggctaaagagaaagcggaagcagaacgtttagcggaggaaaaatcggcgaaagagagagcggaagcggagcgtttagaagctgaaaagatatcaaaagccaaagggatagatattgaagagaaaggattttcaacagccccttactcatctagtcaagaaggtaatataaaggtagaacattggggaaatttgtataaccaaaaatattctgttgtcgttgtaacaacaaccactaaaagagggtgggataatgatgtttatgtaaattctgatgtatctactgtagatgttagaggtcttaaaactgacgttctacctaaggaaggtaaagctacttacacagggcaagcgtttgattatagattctatcgctctggtgatttgtcatatgatgtagatttttctcaaagaattggttctggaaagattagaaatccacatggagatagttataccttatcgcaggggaacattgacaatggatcaatttcggggacggcatcaaaacatcaaggtaatccagactacaatagcggaaactatacaggtgggaattataaagttcaattttttggaccaaatgctgaagaaattggaggagagttaaatattggtgatgaaaaacttggtcttgccggcactcgtggcgatatccaacaataa

SEQ ID NO: 760 - protein, 298 aa, B. trehalosi
MSIKKVTLASLILLSLTACSSGGSGGSSNNVEKQNTNPQTTQQQTDKAAKEKAEAERLAAEKAAKEKAEAERLAAEKAAKEKAEAERLAEEKSAKERAEAERLEAEKISKAKGIDIEEKGFSTAPYSSSQEGNIKVEHWGNLYNQKYSVVVVTTTTKRGWDNDVYVNSDVSTVDVRGLKTDVLPKEGKATYTGQAFDYRFYRSGDLSYDVDFSQRIGSGKIRNPHGDSYTLSQGNIDNGSISGTASKHQGNPDYNSGNYTGGNYKVQFFGPNAEEIGGELNIGDEKLGLAGTRGDIQQ

SEQ ID NO: 761 - DNA, 1962 bp, C. kuhniae
gtggtaaattgttttaagaatgatttgcattttttctttggattgcccgtgcctgcgggcaaggaaaccgtcatgaagtccacattttccggtaaaaatcttttgttgtgcctgctgttgtctgcgtgcgcgggcggcagtttcgatgtcgaccctgtggtggtggtcagtccgccgccgccggacgaccgcgccaatttgctgaaagatgccgacaccccgcccaaaatttccgcgcccgaagccgaaggctttatgaagcccgctttgggctacagcatgccgattctgcgccgcaacaaatcgcgtaccgatgcggcaggcaaggaaattgccaacggcaaacaggcggaagagcatttgctgctcaagccgtccgacatccgcgccctgcaccccaccgacatcgttgccgcaccgcatcgggacgaattggcaaaacgccagcccgatgcgggggtggacgtgtccacgcccgcgcagcgcggctatcaatttgtgcatgcgggctatttggttagcgacaagtttgattcttcagttgaatttgataggcgcaagggcattgattacgaaggcagcgaaggctatgtgttttatcagggacgcaaccccgcgcaagccttgccgagccaaaccgtgcgctatgaagggcattgggatttcgttaccgatgtcaaacgccaccgcaccaatttgtttcacaacggtgatgagggcggtgccgagattgttggcggcggtaggcaaatgggttttgaagatttgtatggcgaaagcaccggtgcggtgggcatggcggaaatcgatgttgccaaagacaaaaaactcggctttcgcgcccgccagcatttgagtgagtttgaagtggattttgccaacaaatctttgaccggcaagctgaactaccgtccccatcagccgataaccggcgaccccgacctgcccgtgcgtacccgctacaccattgatgccaaaatcaacggcaaccgctttagcggcaaggtcaaagcggtggacagggaaaatccgcgcaattacttctttcttgccgattcggattttctggaaggcggtttttacggcgggcgcggtgaggagctggcgggcaaattcttggcaaacgacaactccctgttcggcgtgtttgccgccaagcaggacaatcctgccgatgccgaaaaaatcaccgatgcctacgacatcaacatcagcagcagcgatgcggtcgcgctgcgcccgatgtccaatttcggcagtgccgacaagctgctggtggacggcgaaaccctgtcgctgctgcccgacaacaacgaattgctgacacggcgggacgtaaccctgccttcggggcgcgaagtgggcgtaaccgtgtgctgcggcaatttgtcgtatctgaaattcggtcatatgcgtaaaaccaagctggcggacgaccccgcgcccgttgctgccggtgcggacgatgttgccaccgacagtgccgcttttagcggcgcaccctacggctcgttcctgtttgtgcagggcgagcgcacccgcagtgccgatatgcctgcggaagacggtgcaacctatcgcggcacgtgggacggcttcagcatgaaaaacatcgcgtggcgcagcctgcccggttcgggcacggcggaatttaaagtggatttcggcacgaaagacgtgagcggacgtttgaccgaaaccaacggcgtgcgccccgctttctacatcgatgccaaaattcagggcaacggctttgccggcacggtacgcacccatgcggacggcatcaacctcgaccccggccgcgaaggcaacagccccaaactgctgttccgcgatgttgccgtgcagggcggtttttacgggccaaaagcactggaattgggcggcacgtttttcaacgacgaacacaaaacgggcgcggtattcggcgccaaacgtcaggtatctggcgacaaataa

SEQ ID NO: 762 - protein, 645 aa, C. kuhniae
MHFFFGLPVPAGKETVMKSTFSGKNLLLCLLLSACAGGSFDVDPVVVVSPPPPDDRANLLKDADTPPKISAPEAEGFMKPALGYSMPILRRNKSRTDAAGKEIANGKQAEEHLLLKPSDIRALHPTDIVAAPHRDELAKRQPDAGVDVSTPAQRGYQFVHAGYLVSDKFDSSVEFDRRKGIDYEGSEGYVFYQGRNPAQALPSQTVRYEGHWDFVTDVKRHRTNLFHNGDEGGAEIVGGGRQMGFEDLYGESTGAVGMAEIDVAKDKKLGFRARQHLSEFEVDFANKSLTGKLNYRPHQPITGDPDLPVRTRYTIDAKINGNRFSGKVKAVDRENPRNYFFLADSDFLEGGFYGGRGEELAGKFLANDNSLFGVFAAKQDNPADAEKITDAYDINISSSDAVALRPMSNFGSADKLLVDGETLSLLPDNNELLTRRDVTLPSGREVGVTVCCGNLSYLKFGHMRKTKLADDPAPVAAGADDVATDSAAFSGAPYGSFLFVQGERTRSADMPAEDGATYRGTWDGFSMKNIAWRSLPGSGTAEFKVDFGTKDVSGRLTETNGVRPAFYIDAKIQGNGFAGTVRTHADGINLDPGREGNSPKLLFRDVAVQGGFYGPKALELGGTFFNDEHKTGAVFGAKRQVSGDK

SEQ ID NO: 763 - DNA, 666 bp, C. kuhniae
atgttcacacgcacaattttctgcatcagcctgtgtgccgccctgtcggcgcacgccgcgcccattccgcaaaccgccacactgcaatatagcggcagctacggcattcccgccaccatgacgtttaagcgcacgggcgacaactacaccgttgccgcgcaaatcaatgtgccgatgtacaaaatccgttttgaaagcggcggcaaaattgtcggcaaccaattgaaacccgcttactaccgcgacgtgcgcaacggcaaaacctacgcttcggcacagttttccggcaacaaagccagctacggcaaagcgggcgagccgccgcaaagccgcaccgtatcggggaatgtgatggatttgtttaccctgtcgtggcagatggcgtttgcagacgggcagcttcccgccaatttaagcatcaccaacggcaaaaaactctatccgctcaatggtatcagcaaggcgggcagcaagcagatgaatatcggcggcgggcagacggctgtaaaccaatttcacgtcaaacgcggcgatgacacggtttattacgcttttgtgcccgcgctgaacaacgttcccgccgtgattacctatcaggacggcggtaaaaaatacaacttgacgctcaaatccgttaccatcaacggcaaagccgtgaaaccttga

SEQ ID NO: 764 - protein, 221 aa, C. kuhniae
MFTRTIFCISLCAALSAHAAPIPQTATLQYSGSYGIPATMTFKRTGDNYTVAAQINVPMYKIRFESGGKIVGNQLKPAYYRDVRNGKTYASAQFSGNKASYGKAGEPPQSRTVSGNVMDLFTLSWQMAFADGQLPANLSITNGKKLYPLNGISKAGSKQMNIGGGQTAVNQFHVKRGDDTVYYAFVPALNNVPAVITYQDGGKKYNLTLKSVTINGKAVKP

SEQ ID NO: 765 - DNA, 1014 bp, C. kuhniae
atgaaagtgatttgtgcggctgtggcggcagtctttttgttgggcggctgcttgggcagcaatttgggcgagccggtttcgcccgttcccattcccctgctcgagcctgtgcgcgacaatccccccgttgatgccgaagccgcaccgcgcatgcaaacgctgcgtacggcaggcaatgtcggcggcacggtcgaaaccgtgcgcaccacccgcaacgtcaatggcttgagcatcaccgaacccgagctggtgtaccgccatcgggacggcaccgtgtaccgcttcaatgcctttagcgacccgattgtgccgtcatacggcagcccgtcttggcaattcatcaccaaacagcccggacaagacagccggcacggcaagctgtttgcgtgctgtacccgttcggcgcaattcggttacgcgcccgccaccaagctgcaacacgtccgcttcggcgcatggcagaaaaacggcatggcagagctgtttgtcggcggcaaaaccgccgatgcggcactgatgccgggcggcagccacgatgcggtacgcaacaccaaaggcaaagccacatatgaagtttgggcattgcgcgtgaaagacggcgcattcgttacatcgtcctatacgcccaaagcactgggctttaacaacaaaggcgaacccgtactgtcgctgtttaccgccaacttcaacaccggcaaactcggcggcaccatcatcggcaaccaagatttcggtgccgacgtggtgctgcaagatgtggacattcacggcaacgccttttccggcactgcccaatcgggcgggcggcaaggcttggtggacggacgctttttcggcgaaccgcgcacctacggcgacggtgagaacaaacgcatcaccggccctgccaccgacgaaatcggcggcaaaatcgtgtttgacgggcaccgccacctcgataccgtattcggcggcaaacgcaccaacgaacaatacaacgacacctccaccgatttgaccccgctcaatccgtaa

SEQ ID NO: 766 - protein, 339 aa, C. kuhniae
MLMKVICAAVAAVFLLGGCLGSNLGEPVSPVPIPLLEPVRDNPPVDAEAAPRMQTLRTAGNVGGTVETVRTTRNVNGLSITEPELVYRHRDGTVYRFNAFSDPIVPSYGSPSWQFITKQPGQDSRHGKLFACCTRSAQFGYAPATKLQHVRFGAWQKNGMAELFVGGKTADAALMPGGSHDAVRNTKGKATYEVWALRVKDGAFVTSSYTPKALGFNNKGEPVLSLFTANFNTGKLGGTIIGNQDFGADVVLQDVDIHGNAFSGTAQSGGRQGLVDGRFFGEPRTYGDGENKRITGPATDEIGGKIVFDGHRHLDTVFGGKRTNEQYNDTSTDLTPLNP

SEQ ID NO: 767 - DNA, 2121 bp, C. steedae
atgaaatccgcctttcgcccgtctgctgtggctatgtgcctgttgcttgctgcctgtgctggcggcggcagttttgacgttcagcccgttactgtggtcaatcccgaattcaaagaacccgttgccaccgaaaaagacgaaaccaccccgcctaaagtcttgccgcaggaagccgagggcatcatgaaacccgctttgggctacagcatgccgattccgcgccgcaatgtttcgcgttacgatgccgataaaaaactgcttcccgatggcaaacaagtagaagaatatctgcccttaaacccccaagaccttaaagccttacaccccaccgacattaccgctgcgccccatgctgccgatttggcaaaacgtcaggaaggcgtgcggattgatgtgtctaatcccgcccaacgcggttacgaatttgtgcatgcgggctatattttcagcgactttcaccgttccaaaggcgaagaatcagcaggtttattgcgcgaaggtgtagacggctatattttttatcagggacgcaatcccgcccaagccctgcctgtaggcaaaaccgtaaactacacaggacattgggaatttgttagcgatgccaaacgcgcccgcgatacttattgtaacaatacgggttgccatgtgtatggcggcggcggcgcattgggcttttggttgggctacggcgacagcgtgggtgcgacttcgtttgccgaaaccgccaccgccgaatcgcccgatttgggctggcgcggacgcgaacacgtcagcgaatttaccgccgattttgccaataaaaaattaacgggcacactcaaataccgtccgtggacacgcaggggcgaatcaccagccgaattaaaaacccgctacaccattgatgccaccattcaaaacaaccgttttagcggcaaagccacggcagcggacaagcaaaatccgaaaaacctgctgttcaaatccgattccgcgctgttggaaggcggtttttacggcgggaatgcccaagaattggcgggtaaatttttaacggacgacaacaccctgtttggcgtgtttgccgccaaacagcaaaatcccgccgaaaccgaaaaagtgatggatgcctaccaaattaaccgcgatggcgaccaccccgtgttgcgccagcccatgcccaatttcggtagtgccgacaaattggtattggaaggcaaaaccctgtcgctgttgcccgaagatggtaagttcctaaccagtcgcgaaatcactttggattcggggcgcaccgtgaaagtgaccgtgtgttgcgccaatttggattatttgaaattcggcagcgtcagcaaatccaaattggcaggcgacgacccgcccaaagaagacgatgaggaagaggaagacgaagaatttgacgagggcgaagggttggatgaaggcgagggcagcgataccgccgaaaacaacagctcaaccgataacgccacatcttctgacaacgataagggcgataacaccgccgttgcaggtgataacggcagtaccgataccgccgccaacgacagcagcggcggcgattcggaagagggcgaagacgaaggcgaagagggcgacacacccaaactggtggataatcctgccgaagacagcttggcgtttagcggtgcgccttatggttcgttcctgtttattcagggcgagcgcacccgcagtgccgatatgccgcaaaacggtcaagcccgttatttggggacttgggaaggttttaccaataaagatttggcatggcgcaccctgccgggcaacgggcgtgccgacagcaaagccgattttcaagtggattttggtgccaaaactttaagcggcactttaaccgaacacaacggcgtgcgtcccgctttcttcattgatgccgatgtgaaaggcaacggctttgcgggtacggtgcgcacccattccgatggcgtggtgttggaccccggtcgtgaaggcggcagcccccgcttgctgtttggcgacattcccgtaaaaggcggtttttatggtccaaaagcgtctgaattgggcgggtcgtttttcagtgacgaacacaaagcaggtgcggtttttggcggcaaacgtcaaagcacggcgcaataa

SEQ ID NO: 768 - protein, 706 aa, C. steedae
MKSAFRPSAVAMCLLLAACAGGGSFDVQPVTVVNPEFKEPVATEKDETTPPKVLPQEAEGIMKPALGYSMPIPRRNVSRYDADKKLLPDGKQVEEYLPLNPQDLKALHPTDITAAPHAADLAKRQEGVRIDVSNPAQRGYEFVHAGYIFSDFHRSKGEESAGLLREGVDGYIFYQGRNPAQALPVGKTVNYTGHWEFVSDAKRARDTYCNNTGCHVYGGGGALGFWLGYGDSVGATSFAETATAESPDLGWRGREHVSEFTADFANKKLTGTLKYRPWTRRGESPAELKTRYTIDATIQNNRFSGKATAADKQNPKNLLFKSDSALLEGGFYGGNAQELAGKFLTDDNTLFGVFAAKQQNPAETEKVMDAYQINRDGDHPVLRQPMPNFGSADKLVLEGKTLSLLPEDGKFLTSREITLDSGRTVKVTVCCANLDYLKFGSVSKSKLAGDDPPKEDDEEEEDEEFDEGEGLDEGEGSDTAENNSSTDNATSSDNDKGDNTAVAGDNGSTDTAANDSSGGDSEEGEDEGEEGDTPKLVDNPAEDSLAFSGAPYGSFLFIQGERTRSADMPQNGQARYLGTWEGFTNKDLAWRTLPGNGRADSKADFQVDFGAKTLSGTLTEHNGVRPAFFIDADVKGNGFAGTVRTHSDGVVLDPGREGGSPRLLFGDIPVKGGFYGPKASELGGSFFSDEHKAGAVFGGKRQSTAQ

SEQ ID NO: 769 - DNA, 1002 bp, C. steedae
atgaaaaccatttgtattgccgtgagcttggtctgtgtattgggcgggtgcgcgggcagcagcatcaccgaaccaaaaggacctgtggatatccccactttaccctctgccaacaataatcaatcgtttaaacccaatgaaaccctgcctgcacggatgcaaaccctcagcactgccgatacacccagcggacaactggaagcagtggatgtccctgcacgctttaccggcacgcccgaacccgaattgatgtaccgcaccaaagacggcacgctgtaccgcttcagcgagtttaccaatccgattgtacccagttcgtttagcccgtcttggaaaatggaaacccgacatcaggggcaaaataccgaaaaacacggcaaaatgatggtgtgttgcagcggcggcggcgtgttccgttatgcagcggcaaccgatttgaaacacgtccgttttggcgcgtggggcaacggcgaattgtttgtgggcggcatggtgtccgaccctgccttgatgccaggcggaagccacgaaaaagtacgcgacattaaaggcaaagccacttacgaagtgtgggcattgcgcgtgaaagacggacagtttgtcagttcgtcctacacacccaaatcctataccaattccaaaggcgaacctgtagtgtcgctgtttaccgccaacttcaatacaggaaaaatgggcggaacaattgttggcaacagcgattttggcgcagacgtagaattaaagaatgtggatattcaaggcaatgccttttcgggtacggcacaatcagcaggcaaaatcggacaggtggacggacgctttttcggcgaaccgcgcacttacggttatggtaaatacgttgaaattaccggacctgccaccgaagaaattggcggcaaaatcgtgtttgacggcaaccgcagtttggataccgtatttggcggcaaacgtgttaatgagcaatacaaagatgattcatcggatttgaatccgcttcagtaa

SEQ ID NO: 770 - protein, 333 aa, C. steedae
MKTICIAVSLVCVLGGCAGSSITEPKGPVDIPTLPSANNNQSFKPNETLPARMQTLSTADTPSGQLEAVDVPARFTGTPEPELMYRTKDGTLYRFSEFTNPIVPSSFSPSWKMETRHQGQNTEKHGKMMVCCSGGGVFRYAAATDLKHVRFGAWGNGELFVGGMVSDPALMPGGSHEKVRDIKGKATYEVWALRVKDGQFVSSSYTPKSYTNSKGEPVVSLFTANFNTGKMGGTIVGNSDFGADVELKNVDIQGNAFSGTAQSAGKIGQVDGRFFGEPRTYGYGKYVEITGPATEEIGGKIVFDGNRSLDTVFGGKRVNEQYKDDSSDLNPLQ

SEQ ID NO: 771 - DNA, 3396 bp, C. valvarum
atgaaactaagcaacctgactattgccgtcctcatcgcactcggcaccgccgcctgcggtggcagtggtgatgccgccaaaccaccccacgttgacccgcagccgaagccggccccgcagccggataacggcaagaaccagccgggccgcgatgacaaagccctggttgacccgaccaatacccacgtggtggataaccgcgacctcagcaaagaaagcaccgtcggcgggctgcaatacatccgccgcgatggctcaggatacgaccgcgccaacaaccccgaaaaaatggcatccgccaccccgctgctcggcgtttccctgaaccgacagaacccgaaactgaccaacatcgtcctcgcccgccgggaccttgactatcacgatggccgacccgtccgcgcccaatttgccggcggcaccgatgttgagccgctaaccgctgcaggcaagccgcgtgaagacgatagcttgcaggtagaaaacttcaaaaacgtggatgtcctcgccggggcattcaagcaggttggctcggcggtattcagtgatccgaataaccgccttaacggcaccacccataacattgatacccatatccagaacaacaccgataaagacggcgaatttacccgcgaacgggtcacccacgtctataccccgcgttacgaataccgccagccctatgtggattatccccacgctaaaaacgaggcggatattggcaaagaacacgcggaaaaccggatcggtccggaaggcacaagcttcaccaccgcgccaccaccgccgatttttaataacccggaaaaacgaccggaagacagggttacttccattaacgatctagaaaaaaaactgaaaggcgatcatctatgggcaactcgcaacgtgaacgacaattcccgctggatcaccaatatcggcacccgcactacctatgcaagtggggagatctataacgaccaagaccgttacggtaatttcccggcatccggttcccccgatccagctgccgataatcactatgatgacagccctaccgacggagacggtcatttcccggcaacttcatggcgcaacaacctgacgcaacttccggacagaacacccaacaacgacatcaaccactggtcatacaaatataacggcggcaatatcgccgatgataccgggaatattgacgacactgcgcgcaaatataaccgggtggactggaacggtagcagtgcaaacgactccaaagatcccaaacgttggggcgcttacgccggtaagcaacggggtgataaacgtattgatgccggcggcatcaccccgcaggacgcggagccagattacaggcgggattatcccaacggtgcttaccccaaacatccaaaaacgttgtttgcctacccgaacagaccttatgacgaagcaaacaacaatgccattgataccaggaaaaggggcagagcagataccaacccgatggatcacgaacatatctatctggaacgcgaggaatataccgccatccgtcaaataaaaggcattcgcccgctggtgaatcccgtcccgaatgaatgggattggacactgaaacaggtgtggggggttacctacaatatagatgtgcagaagaggaaacaggtgtgggtgcagaatggtccaaatcctggagatggttactataggtgggaaaatgatggtgcttctcgcacggttaaagaagggacgccactgtctgaagaggtaaaaccgcctgtcgaagataatgagcataccactatcactgcaaacggaaccgtgtcaaacctcaacaataggacgttaactgacggtacggtatgtgacggcggggcaaccttatgcacgatccgtccaggtggcgaaggcgaagagaagagctgggtcaagcacctgatcagcgccgaatggattaagcccatcaacaccggcggcggagtgcgcggtgaattccgtggcccgccctacatcggctggaaagaagatgaccgcgtcgtccgttttgccgataaccgcatctggaaaccgggtacccccggctacaagcccgaatatgaaaacaaatacggtgccaacctcatctggtggagcacccaggacagcgcctttgaaaactgggcaaccagtgaaggctggaacccacgtgcccgtcgtgtcgatatcaataccgagaattgccccggcggcgacaaatgcggcgagggtaaagaagacctggtctggggcaaaaataccaagccgcgcggcgttaacgcccgcgaccgcgacgtggagatccagccaaccggcgacatcaccaacggcctgatccgtatcggtggctatggcaaccatggcgacggtcagcctgacaccatgcgcaccctcggcgaagagctgacgtttgacggcgcccgctggaacgatcaccacaagaccacgacccgcatcttcggtcactaccaccttgcctacgccgaccaggacgaccgctccgtcaaggcgatgagcatgaacagctattcgggcgcgcgctcgtttgtctcccaagtggaaggcacattggcaacgcccacggcgcaaggctatcgcgcggatctggacagcaagccgacccaatacagcctcggcgcgaaaccgatcaccctgaaaaaagtgcaatatggccgggtgaccaccaatctcgacctcaccgcgagtggtaccaaactcctgccgaacggcttcctgcgtgcaccgtttgagaagaaaggcaccggcgacagcgttgataactacttcttccgtggtgtggatgaaaccaccattgagcaaatgaatgctctgccgtccaaccaggtcgcgcgctacgaaggccacgcgctgatgtacggcattgacaacagcttccacggcatccgcaccaatcgcagtcaaaaagacctgccgaacgccttcgacggtaccggcggccagaacgcgaccgcccacacccttggtttgggtaacttcgttgaagcagaggtgaacttcggtaccaagaaagtgaccggcgatgtctataacgcctggctggagcaactggacaaacccggcgtgtataaagacaaactcgtcaccttcagcgggaatgtaatcggcaacaccgtcatcggcaccgccgaccgcacctatgcccccggcaacgatgaggcagacttccgcgccgccttctacggcagccaggcggatgaaatgggcggcagcttcaactccgtgaaagccaccaataaatacggctctgcttacgaagtgggcgattggggcggcgtattcggcgccaccaaagtcggcaccaacaccttccagggtgatgatggcggccaaacctacggcggaggcagtgccccggcacaaactcccaacgtcgccgaccgttacgcaccgtaa

SEQ ID NO: 772 - protein, 1131 aa, C. valvarum
MKLSNLTIAVLIALGTAACGGSGDAAKPPHVDPQPKPAPQPDNGKNQPGRDDKALVDPTNTHVVDNRDLSKESTVGGLQYIRRDGSGYDRANNPEKMASATPLLGVSLNRQNPKLTNIVLARRDLDYHDGRPVRAQFAGGTDVEPLTAAGKPREDDSLQVENFKNVDVLAGAFKQVGSAVFSDPNNRLNGTTHNIDTHIQNNTDKDGEFTRERVTHVYTPRYEYRQPYVDYPHAKNEADIGKEHAENRIGPEGTSFTTAPPPPIFNNPEKRPEDRVTSINDLEKKLKGDHLWATRNVNDNSRWITNIGTRTTYASGEIYNDQDRYGNFPASGSPDPAADNHYDDSPTDGDGHFPATSWRNNLTQLPDRTPNNDINHWSYKYNGGNIADDTGNIDDTARKYNRVDWNGSSANDSKDPKRWGAYAGKQRGDKRIDAGGITPQDAEPDYRRDYPNGAYPKHPKTLFAYPNRPYDEANNNAIDTRKRGRADTNPMDHEHIYLEREEYTAIRQIKGIRPLVNPVPNEWDWTLKQVWGVTYNIDVQKRKQVWVQNGPNPGDGYYRWENDGASRTVKEGTPLSEEVKPPVEDNEHTTITANGTVSNLNNRTLTDGTVCDGGATLCTIRPGGEGEEKSWVKHLISAEWIKPINTGGGVRGEFRGPPYIGWKEDDRVVRFADNRIWKPGTPGYKPEYENKYGANLIWWSTQDSAFENWATSEGWNPRARRVDINTENCPGGDKCGEGKEDLVWGKNTKPRGVNARDRDVEIQPTGDITNGLIRIGGYGNHGDGQPDTMRTLGEELTFDGARWNDHHKTTTRIFGHYHLAYADQDDRSVKAMSMNSYSGARSFVSQVEGTLATPTAQGYRADLDSKPTQYSLGAKPITLKKVQYGRVTTNLDLTASGTKLLPNGFLRAPFEKKGTGDSVDNYFFRGVDETTIEQMNALPSNQVARYEGHALMYGIDNSFHGIRTNRSQKDLPNAFDGTGGQNATAHTLGLGNFVEAEVNFGTKKVTGDVYNAWLEQLDKPGVYKDKLVTFSGNVIGNTVIGTADRTYAPGNDEADFRAAFYGSQADEMGGSFNSVKATNKYGSAYEVGDWGGVFGATKVGTNTFQGDDGGQTYGGGSAPAQTPNVADRYAP

SEQ ID NO: 773 - DNA, 765 bp, Caulobacter sp. AP07
atgacccgttcgaccttcaagacgttgatcctggcgcccatcgccgccctggccctgtgcggcgtcgcccaggccgccatcgtcggccaatcgaccgatacgacccaactgcgggtcggaaccagcaccatcaacgccggtccgcacacctccggcaagccgggcgtcgccgtcgccggcatcggcctttccagctacgtcgacttcgcgggcctgcaggcctcgatcccgccggtcaacggcgtgaccaccatcaacagcccctccagcgcccccggtagccacaacggcatgggcgtgttcaacttcgccaaggtcagcaacgccgacctctatttcggcgaatggtcggacaccgccaacgtcgctgacggcacccacaccgtctactatgtcggcgacaacaccggcacgacggtcccgaccacgggttcggccacctatgcggtgaaggggatcagcggctacgccgccaacggccccctgaccggaaccttcacggccaacttcggcgccagcaccctgagcggaagcatcgccagcgcctcgaccggctacacggtcaacatcggctcggtgggcatctccggcgccaacatcgccagcaccaccagcaacgccacggcgacgcagtccaccaccctggcctcgggtggcagcgtcagcggccagttcttcggcgccaacgccgcggccctggcgggcctcgtcaccttcggcggcaacagccagtatgacaccgccttcggcggcacgaagaactag

SEQ ID NO: 774 - protein, 254 aa, Caulobacter sp. AP07
MTRSTFKTLILAPIAALALCGVAQAAIVGQSTDTTQLRVGTSTINAGPHTSGKPGVAVAGIGLSSYVDFAGLQASIPPVNGVTTINSPSSAPGSHNGMGVFNFAKVSNADLYFGEWSDTANVADGTHTVYYVGDNTGTTVPTTGSATYAVKGISGYAANGPLTGTFTANFGASTLSGSIASASTGYTVNIGSVGISGANIASTTSNATATQSTTLASGGSVSGQFFGANAAALAGLVTFGGNSQYDTAFGGTKN

SEQ ID NO: 775 - DNA, 2595 bp, D. alkaliphilus
atgtctcagcgccctctattgcagcccgtggtttttcttgccgccctggtttgcctgctggccgttaccttctggtcggcgccgccggcgaccgctgccgaagaagtggccacggtggtggccctgcgcggtacggcggtggcggtggatgccgccggcgccgagcgtgccctggccatcaaggcgcccatccaccggcaagataccatccgcaccgggccccgggggcggctgcagctgatgttcaccgacaacaccatcatcagcctgggggttaacgccgagctggagattgccgaatatcagtgggaccagcaggaaggggagctgaacacccgggtcaaccagggggcctttcgggtaatgggcggctctgtggcccgcacctcgccggaaaaattcaccaccgacacccccgctgccaccatcggtatccgtggctccatgtacgccggccgggtaagcgacggcgccctggcggtggtcttccagggcggcaccgggattatcgtcagcaacccggcgggcacggtggagattaccacccccggcatgggtacccgggtagcctcccgcaccgccgccccgaccccgcccaccgtcttcacccaggaagacctgggggccctggaagacgaagaggtggatgaagaggccgccgaagaggagacggtggaggatgagacccccgccgaagaaccggccgaggaggagtgggaagatgccgccctggatgagcccgaagaggccgccgccccggtggccgccgccccggctcccatcaccgacaccgccgtggaccaggctaccgaaaccaccaccgacgccgcccaggatgaatgggagcaaacggtggtggaggctgaccccgaaccaaccgatccggatcccaccgacccggaaccaattgacccggaacccaccgacccgtcggaggccgtttattccggccggggtattgaaatcatatacagcagcatgcaagaagaggttgcggttgaacatctggtgctgaccgacaaaccctccgaattgacggaaatcgaggccggcctgttggagtataacgaacagagcgactttagcgacggcgagtacagtgcggtatggtcttacaccgatgcaacgcaagttgaggaatgggaagaaggggacgatttcgacttccagttcacctttgtaatggtcgatgaccgtggcgagttctggctttatgaacaatggtccgacaccgaaaccgacgagagctggacttacagcgagaaaatgtttttctacggctcggaaaccccggtcgacctgatgcccaccagcggtggcgcgatttatcacggtttctttaccggtgccagcgacgatgtggattacggctgggaggagtttttcggtgatttctcgctggcggtgaactgggaaaccggcaaggtggtgggctatttcatagatgacgaacactacggccggccgatccccgtttacctgacgggagaagtggacggttcctcgttgagttcggtttccatttttggcctggactacgatgactacggtgatggcgcactttacgacgcctggataaccaccggcagcggtaccttcgcccagttctacggcacgtattaccaggggctggggcttgtcgccgaagggcagtccggttcgctgtattacgacgatgcacaggaagactggtcggtggtgggcggtggtttccgcgaccccgtctttaccttgccggaacaggctgcttcctccacctggcgggggtttgtcaccgccatggaaatcaacctggtggaggaaccgggcacgccgccggaactgttccgcagtaccagcgccgaatattttgaattgcagatcgatcgccaggccgggatgttcagtggccagatcattgaggccgagtcggccaccaccacaggcctaagcatcggcggcttggaagtggccggcttttacgtgagcgacaacttcctggccggcgagcttagcagcgccagcgatagcgacctgcagggggcgctgggcggcagcggcgaatactatttctacgattttgaagatgaagcggactatttccagatcggcgagctggccgagcacgtctcctggggctactggggagcggcctttaccggccaggacgagatgccgtacctgatcagccccgccggctctttctgggtggccggtgagcttaccccggcagatacggtgctgggaatgatcgatgccgaagtaaccggcacctatgagggaggggctgagggaatactgatcttcgaaggcaccatggctgacctctacaatgggcaaaccaccctgaacatcaatttcggcgacgctaacatcaacggcagcatcaccttctcggagattgccgaactgaccatagatggaagctcctcgcttggccccgatggctttgccgccgatgtcacttcggtagagttttttggtggtgaaccaactctcgcgtccggcggcatcagcggcgctttcttcggccccaacgccgaatccgttggcggcaacttccacgccgaaggcggcggggcccagtttctgggcatctttggaggcgaccgttga

SEQ ID NO: 776 - protein, 864 aa, D. alkaliphilus
MSQRPLLQPVVFLAALVCLLAVTFWSAPPATAAEEVATVVALRGTAVAVDAAGAERALAIKAPIHRQDTIRTGPRGRLQLMFTDNTIISLGVNAELEIAEYQWDQQEGELNTRVNQGAFRVMGGSVARTSPEKFTTDTPAATIGIRGSMYAGRVSDGALAVVFQGGTGIIVSNPAGTVEITTPGMGTRVASRTAAPTPPTVFTQEDLGALEDEEVDEEAAEEETVEDETPAEEPAEEEWEDAALDEPEEAAAPVAAAPAPITDTAVDQATETTTDAAQDEWEQTVVEADPEPTDPDPTDPEPIDPEPTDPSEAVYSGRGIEIIYSSMQEEVAVEHLVLTDKPSELTEIEAGLLEYNEQSDFSDGEYSAVWSYTDATQVEEWEEGDDFDFQFTFVMVDDRGEFWLYEQWSDTETDESWTYSEKMFFYGSETPVDLMPTSGGAIYHGFFTGASDDVDYGWEEFFGDFSLAVNWETGKVVGYFIDDEHYGRPIPVYLTGEVDGSSLSSVSIFGLDYDDYGDGALYDAWITTGSGTFAQFYGTYYQGLGLVAEGQSGSLYYDDAQEDWSVVGGGFRDPVFTLPEQAASSTWRGFVTAMEINLVEEPGTPPELFRSTSAEYFELQIDRQAGMFSGQIIEAESATTTGLSIGGLEVAGFYVSDNFLAGELSSASDSDLQGALGGSGEYYFYDFEDEADYFQIGELAEHVSWGYWGAAFTGQDEMPYLISPAGSFWVAGELTPADTVLGMIDAEVTGTYEGGAEGILIFEGTMADLYNGQTTLNINFGDANINGSITFSEIAELTIDGSSSLGPDGFAADVTSVEFFGGEPTLASGGISGAFFGPNAESVGGNFHAEGGGAQFLGIFGGDR

SEQ ID NO: 777 - DNA, 342 bp, D. nodosus
atgaaatttaaattatgctttttaataacgctggcaggttgcgtgcaaagcgacagcatcagtcattttcaaacgcgttctacattgcgttatttaggtgacggttttcaaagcgaacaaagcggttatcaatatcaaacgggcgccgcgccgttgggttttcaagcggtggtgcgcggcgacaatatggcgctggaaattgaacaacccgcctttattgaacgcggacaatatcgccctgatatgtgtttggaaccgtttttttatcgcgggcggcaatattatcggcaagtttcttgccatcattacgagccgcgaagtggtattcgtattacccgttaa

SEQ ID NO: 778 - protein, 113 aa, D. nodosus
MKFKLCFLITLAGCVQSDSISHFQTRSTLRYLGDGFQSEQSGYQYQTGAAPLGFQAVVRGDNMALEIEQPAFIERGQYRPDMCLEPFFYRGRQYYRQVSCHHYEPRSGIRITR

SEQ ID NO: 779 - DNA, 879 bp, D. shibae
atgtcaaagacccttacacgatctgtcgcgctgcttgtgctggcccctgtgctgacggcctgtggcggcggcgggggctccggttccgcgaccccgttcacctccttcaacgacctgcccgagaccggcaccgtagagttgcaaggccaggcccggaccgcgcgcttcgcggtggatccggtcaccggccaactcagcctctcgaacctgtcggacaccgaggacagcacgctgcggctgacaaccgccaacggcctgataccgcgcgtggcgatccgggcccccgactccgccgtcgcgttcgatctggaccagggggccacagtccaggtggatggccccgtcgtcttcttcgaaagcgatgatgggcggcgcttcgcgctgctgctcgatggcggccggggcggtccgttcgagtaccagaccctcggagcctggctggacgggttcggcgcggagcgcggcaccttgggcgcgggggcttatggcgcgcggacgcccagcgcgcggttgcccaccgggcaggtcgccacctatgtcggtgagggcgccgggtttgcgcgacgggccgatggcgagggctatctcaccgtctcggccatcgaggtgacgaccgatttccggcaggcggagatcctcagcacgcagacgcaggcgatttccctcgcaacctcggacacaattcccgccccggagctggatttcgacggcagtgggccggtctcgggtgggggattcaccgcggcggtgtccgggccgggctcggcgggggaggcgcagggcgtgttccatggccccaatgccgaggaggtggccgggacctacagcctgagcgggccgggcggcgtggcgcatatcggcgcgttcggcggcaactga

SEQ ID NO: 780 - protein, 292 aa, D. shibae
MSKTLTRSVALLVLAPVLTACGGGGGSGSATPFTSFNDLPETGTVELQGQARTARFAVDPVTGQLSLSNLSDTEDSTLRLTTANGLIPRVAIRAPDSAVAFDLDQGATVQVDGPVVFFESDDGRRFALLLDGGRGGPFEYQTLGAWLDGFGAERGTLGAGAYGARTPSARLPTGQVATYVGEGAGFARRADGEGYLTVSAIEVTTDFRQAEILSTQTQAISLATSDTIPAPELDFDGSGPVSGGGFTAAVSGPGSAGEAQGVFHGPNAEEVAGTYSLSGPGGVAHIGAFGGN

SEQ ID NO: 781 - DNA, 849 bp, E. corrodens
atgcaaaagcatcacattctttacattgccatcactgcccttaccctaggcggctgcggcagcgccggtaactcactggccaatgcgattactgatccgtttacacccaaagaaggcggttatcgccaactgagcaatatcggctcggatgagttcacccacacaggtctactgcccaccataggcagtagacaggcatcgactatcaggattacagacgaccaattcatcggcacacagaatcatgaaaaagactactccagccgcgatacaatccctatcggccacaaacggcagaacgccttcacctccctgccctatgtgctgaaagatagcagtgggaaccaaatggaaagcggcgttttggaagtttacaaacaggcctactccgccgtggtgggcgcgcaactgcacaacagaatcgagcccggccatccggccacgccaacccgcgacttctatgttcgctccatccaaggtgaattcaccagcaatctgcccacccaaggcatcatcacctataaaggccgggcaatgacaggctcggttaccggctcagctgaccacagcaatggtttgaactatcaaattgattacggtgcaagaaaaggccacggctcgattaccggcttaaacggtttcggcaatattgatttggcagaagcaccgattacccaaaacccgcatggtcataatgtgattaacggcgcagccaattctgccacacacggggcgggtaattacgagctcggcatttttggtccgcaagccaatgaaattgccggtaaggcacatttcaacaatcagccgaacaaggaagtcggtttcgccggcggacgggtaaattaa

SEQ ID NO: 782 - protein, 282 aa, E. corrodens
MQKHHILYIAITALTLGGCGSAGNSLANAITDPFTPKEGGYRQLSNIGSDEFTHTGLLPTIGSRQASTIRITDDQFIGTQNHEKDYSSRDTIPIGHKRQNAFTSLPYVLKDSSGNQMESGVLEVYKQAYSAVVGAQLHNRIEPGHPATPTRDFYVRSIQGEFTSNLPTQGIITYKGRAMTGSVTGSADHSNGLNYQIDYGARKGHGSITGLNGFGNIDLAEAPITQNPHGHNVINGAANSATHGAGNYELGIFGPQANEIAGKAHFNNQPNKEVGFAGGRVN

SEQ ID NO: 783 - DNA, 975 bp, E. corrodens
atgaaacacctgattttatctttgtctgtggctgctgcgttggcaggatgtgccggcagtggcggggtaaccattccagacggtaccgctcctgtaccgccgctgactccggccgactccagcaaaatccttggcccggccagcacaggcgaaacgcccaccaccttccaaaccggtaacgggcagctgcgttatgtgtcgtggtatgtggagtattggggcacgccgtcgtctgaaaacaaattcatctatcaggcgccaaacggtaaaagttatgcctttgatgggttcactaatccgccaagattctccagccgttttacgcccgataaaaaccaacccaccaagatggagccgcaaacctcaagcgatggtaacaagctgctggtgtgctgtgaaaacggtgatgctaatttccccgcaggctacctgcagtctctgcgttatggcgcatggattggtgccgacgggcaaaccgatctattcgcgggcggcatattggccaacacggcggacatgcagaagcgcaatggcgccaccgcacccaccggcaaagctacctacgaagtttgggccttccgcgtgaaaggcggttcggttgtggcctcttcctataacactgataccaaccctgctaaacgggttaattctttgctaaccgttaatttcaacaccggaaaagtgggtggcacgattaaaggcaatgccgattttggtgcggacatcgatttcaacgatgttactgtaaacggcaataccttcagcggcacagcctcttccggcggggtgagcggccaagtgaacggtggcttctacggtaagagcggttggtacgacccggccggtacggaaatcggcggtaaggttactttcaacggcaaccgcagcctcgacagcgtatttggtggttcagccaccgatactcgccgcgacccggataccacggccacagatttaacccccgttaatccctaa

SEQ ID NO: 784 - protein, 324 aa, E. corrodens
MKHLILSLSVAAALAGCAGSGGVTIPDGTAPVPPLTPADSSKILGPASTGETPTTFQTGNGQLRYVSWYVEYWGTPSSENKFIYQAPNGKSYAFDGFTNPPRFSSRFTPDKNQPTKMEPQTSSDGNKLLVCCENGDANFPAGYLQSLRYGAWIGADGQTDLFAGGILANTADMQKRNGATAPTGKATYEVWAFRVKGGSVVASSYNTDTNPAKRVNSLLTVNFNTGKVGGTIKGNADFGADIDFNDVTVNGNTFSGTASSGGVSGQVNGGFYGKSGWYDPAGTEIGGKVTFNGNRSLDSVFGGSATDTRRDPDTTATDLTPVNP

SEQ ID NO: 785 - DNA, 945 bp, E. hoshinae
atgcaacctcgctatagcgcactcttcttactcttatcttctacgctgttgaccgcctgcggcggcggtggcgctggtggcgatgccgcgtcagcgcaggccatcgcgccggcggcacctgtcccccaaccgctcgcagcgacggctcccgccgcccagcctctcgcacccgcgccgacggcacccggcgttccacccgcgacgccccctgccgcccccccggccgccgccttcggtgagcaaggcacagtataccaggcgcaactgcgggagatcggccgccacgacgccatcaatatatacggttttaacgcactcagccccgacagtgagttcaccgttaaggtggaaggaaccgatatcgctatcgacgtcacgcccatcacccagcaccatgaaaaagatagccgcgtcattaacgatcagaaagtcctgacgctgcgcgatgccgatggcaacctggcgggttactatggccatgtgcacacctatacccaccgcgagacggcgcaggatgaaagcgagcaggatcaaacaaccaccagcctggtctacgcggtcaatgccagcgaaaggcaccgtcctgaaactcaagcggactatgtgggcaccctgttttataaccacttcgatatcccgcgtgaggccgctatccgcctgcactatcaggacaataagatcaccggcgatatcaagggcaccggtctagcccgcgatatcgactacgttatccgggacgatggtgacaataccgtgagcgaagagggaaccttcggcgccagactgcgccatgtcgacgcgcagcgtaacgcggttaacggccacctgatcggcggcttctatggcaaagagggcgaggtcgccgctggcgaggtcaaatttatcgatgactatagcgtagagcgcggcggcgtcttcggcgcacagcgggtcaagcgcaactga

SEQ ID NO: 786 - protein, 314 aa, E. hoshinae
MQPRYSALFLLLSSTLLTACGGGGAGGDAASAQAIAPAAPVPQPLAATAPAAQPLAPAPTAPGVPPATPPAAPPAAAFGEQGTVYQAQLREIGRHDAINIYGFNALSPDSEFTVKVEGTDIAIDVTPITQHHEKDSRVINDQKVLTLRDADGNLAGYYGHVHTYTHRETAQDESEQDQTTTSLVYAVNASERHRPETQADYVGTLFYNHFDIPREAAIRLHYQDNKITGDIKGTGLARDIDYVIRDDGDNTVSEEGTFGARLRHVDAQRNAVNGHLIGGFYGKEGEVAAGEVKFIDDYSVERGGVFGAQRVKRN

SEQ ID NO: 787 - DNA, 942 bp, E. piscicida
atgaaaccacgctatagcacactcttcttactcttatcctctgcgctgttaaccgcctgcggtggcggtggcggtggtggtggcggcggtggcggtggtggcgctagcgatgccgcgccggcacaggccatcgcaccggcggcgcccgcctcccagccgctcgcggtcgtaccggcggcgcccgacgttccccccgttgcgcccgacgttgcgccccctgccgccgccatcgatgaaccggaggcacaataccgcgggctggtgcgggagatcggccaccgtgacaccctcagtatatccggttttaacactctcaatcccaaccgcgagttcaccgttaaggtggagggaaccgatatcgccatcgacgtcgcccccctcataaagcgccatgaaaaggacagccgcgtcattaacggtcagaaagtcctgacgctgcgcgatgccgatggcaagctggcgggttactatggccatgtgcacacctatacccaccgcgagacggcgcagaatgaagacgatcaggaccaaacaaccaccagcctggtatacgcggtcaacgtcaatgaagggcgccgtccagagacccaggcagactatgtgggcaccctgttttataaccacttcgatatcccgcgcgaggccgccatccgtctgcactatcaggacaacaagatcaccggcaatatcaagggtagcggtctggccagcgatatcgactacgttatccgggaggatggtgacaataccgtcagcgaggagggaaccttcggcgccagactgcaccgcgtcggcgcgcagcgtaacgcggttaacggccacctggtcggtgggttctatggcaaagagggcgaagtcgccgccggcgaggtcaaatttatcgataactatagcgtagagcgcggcggcgtcttcggcgcacagcgggtgcagcacgactga

SEQ ID NO: 788 - protein, 313 aa, E. piscicida
MKPRYSTLFLLLSSALLTACGGGGGGGGGGGGGGASDAAPAQAIAPAAPASQPLAVVPAAPDVPPVAPDVAPPAAAIDEPEAQYRGLVREIGHRDTLSISGFNTLNPNREFTVKVEGTDIAIDVAPLIKRHEKDSRVINGQKVLTLRDADGKLAGYYGHVHTYTHRETAQNEDDQDQTTTSLVYAVNVNEGRRPETQADYVGTLFYNHFDIPREAAIRLHYQDNKITGNIKGSGLASDIDYVIREDGDNTVSEEGTFGARLHRVGAQRNAVNGHLVGGFYGKEGEVAAGEVKFIDNYSVERGGVFGAQRVQHD

SEQ ID NO: 789 - DNA, 957 bp, E. tarda
atgaaaccacgctatagcacactcttcttactcttatcctctgcgctgttgaccgcctgctgcggcggcggcggcggcggtagcgatgccgcgcaggcgcaggccatcgcgccggtggccccggcctcccagtccatcgcgccggtagccccgccctcccagcccatcgcgccggtggctcccgcctctcaggccattgcggcagcgcccgaggtgccccccgccgcgctccctgccgccgccttcggtgagccaggggcggtataccgcgcacagctgcgggagatcggcccccatgacaccatcaagatatacggttttgacgcactcagccccgacagcgagttcaccgttaaagtcgaggggaccgatatcgccatcgaggtcacgcccctcccccagcgccatgaaaaggatagccgcaccattaacgatcagacagtcctgacgctgcgcgatgccgatggcaagctggcgggttactatggccatgtgcacacctatacccaccgcgagacggcgcaggatgaagacgatcaggatcagacaaccagcagcctggtctacgcggtcaacgccagcgaaaggcaccgccctgaaacccaggcggactatgaaggcacgctgttttataaccacttcgatatccagcgcgaggccgccatccgcctgcactatcaggacaacaagatcaccggcaatatcaagggcagcggcctagcccgcgatatcgactacgttatccgagacgatggcggcaacaccgtcagcgaggagggcgccttcggcgccagactgcaccatgtcaacgcgccgcgcaacgcggtgaacggccacctgatcggcggcttctatggcaaagagggtgaagtcgccgccggcgaagtcaaatttatcgatgactacagcgtagagcgcggcggcgtcttcggcgcacagcgggtcaagcgcgactga

SEQ ID NO: 790 - protein, 318 aa, E. tarda
MKPRYSTLFLLLSSALLTACCGGGGGGSDAAQAQAIAPVAPASQSIAPVAPPSQPIAPVAPASQAIAAAPEVPPAALPAAAFGEPGAVYRAQLREIGPHDTIKIYGFDALSPDSEFTVKVEGTDIAIEVTPLPQRHEKDSRTINDQTVLTLRDADGKLAGYYGHVHTYTHRETAQDEDDQDQTTSSLVYAVNASERHRPETQADYEGTLFYNHFDIQREAAIRLHYQDNKITGNIKGSGLARDIDYVIRDDGGNTVSEEGAFGARLHHVNAPRNAVNGHLIGGFYGKEGEVAAGEVKFIDDYSVERGGVFGAQRVKRD

SEQ ID NO: 791 - DNA, 786 bp, F. aurantia
atgaaccacaaactcaatacccgactcggcctgctgaccctggggctgttgctggccgcaggagcccaggctcaaagctcgatcagcggcgtgaccagtcgaccgaacgaacgagacctcatccgggttggagaatccaccgtcaatggcggtccccaccactccggggcccccggtatcggcgtgcagtccactgatgccagcaagctggtcgacttcgccggtctggtccgttatggccagactgatgccgccggcgtcaccaccctggcgctggaaagccccaccccgccgcccggcgcgccacccagccatgacagccttggctccttccatttcgccaaggtcagcaatgcggacgtctattatggcgagtggtcgcaaagcgccagtgccagcgacggtacccataccagttattacgtgggtgaccacgccggtaccactgtgcccgccaccggtaccgccacttatgcggtgcaaggcatcagcgactatgccaaccgtggcgccctggccggtacctttgccgccgacttcggcgcccatcagctgacgggctcgctgtccaatggcaactatgccgtggatatcggcaccgccaggattgatggtgcggcgatcagcggcaatcaaggcagtgccagcgtggccggtgccaccgtagccagccagggtgccgtgtccggcagcttcttcggtgccaatgcagcagccctggccggtatcgtggccttcgatcaggcccatcagcatgacaccgcctttggcggcagcaggcaataa

SEQ ID NO: 792 - protein, 261 aa, F. aurantia
MNHKLNTRLGLLTLGLLLAAGAQAQSSISGVTSRPNERDLIRVGESTVNGGPHHSGAPGIGVQSTDASKLVDFAGLVRYGQTDAAGVTTLALESPTPPPGAPPSHDSLGSFHFAKVSNADVYYGEWSQSASASDGTHTSYYVGDHAGTTVPATGTATYAVQGISDYANRGALAGTFAADFGAHQLTGSLSNGNYAVDIGTARIDGAAISGNQGSASVAGATVASQGAVSGSFFGANAAALAGIVAFDQAHQHDTAFGGSRQ

SEQ ID NO: 793 - DNA, 1512 bp, G. anatis
atgaaacagaaaacatttttccaattaagtacaattactttagcatgtgcagcattaatggcgtgtagctcatcttccagtgattctcctgctaaaccacttacagaagcacaattacagcaacagttagataatgctaaaacaaaattagccaaagtaaaacagcaattatctgtagctcaagcagatgttaatcaacatcaacaatcattaactcaaacctcgcagcaattaactcaaactaaacagcaattaactaaagcgcaaagtgatgttaaacagcttgcggatacagtgaatgctaaaaaggcagaagtgagccgtttaactcaagaaatggcagaattggtagaggtacagaaattaggaaacagcaatgatattcagcaaaaactttcgcaaacccaacaagcattggtgaaagcgaacagttctttatctgaagcccaaaaccaattaactaatgccgaaaagcagtcagcttccctgaagaaaactgttgctgagttagagagtaaaaagaaatcgttatctacgcaaattacccaaaaacaggcacagttaagccaattaaccgcacaagtaaaagcgacagaacaagcattagataaagaaaaatctcaacttaaacagctgactccagataatcctattgttgaggcacacgctgaagagaattatatgggagatagatataaatggcgtagtattaaatttgacgagatgatgaatatagaacaaggatcaatatcacaaaatatagatacaaaaggcgtttattatacctcagagagaccatccgttcttgtgcctgatccagtaggtacaggtataaaaggagacggtcgtaattttgaagatattgacttttctcaatatccagtaaattcgcaacagattcaaagtaaagagcagtttgcacaaacatgtgcctcaagagtcgcttgtaacccaacggttaatcgtaaaattgcggaagcacgttttgttaaccaaacctactctacttattttatacatactgctatgaactataattctagtgatgataaatattatcctagatctccaaatatggggtatatatttaaagaattaccgcaggataataatgtatggactagaccatctggccaagagattgttacttatcgaggtaaagtgcttggttctttcaaggaatatcaaaaatacactccagcgcaaggtgatataacgttaaaggctaattttgcagacaatacggtgtctggcacagtaactaatcgtaatggttataagaataatcaggatatagtcttaataaaaacgccaatatcagaacaaggaacaggtaggataggtttttctggtggaatacagtatggttcatatgatgctaataggggaacagatggttcatatgagggtatttttgttggcccgaaagctgaagaagtagtagggtttattgacgatacgtaccgtagaggcattaatggtcagcaagtttttggtgcttcgtccaaataa

SEQ ID NO: 794 - protein, 503 aa, G. anatis
MKQKTFFQLSTITLACAALMACSSSSSDSPAKPLTEAQLQQQLDNAKTKLAKVKQQLSVAQADVNQHQQSLTQTSQQLTQTKQQLTKAQSDVKQLADTVNAKKAEVSRLTQEMAELVEVQKLGNSNDIQQKLSQTQQALVKANSSLSEAQNQLTNAEKQSASLKKTVAELESKKKSLSTQITQKQAQLSQLTAQVKATEQALDKEKSQLKQLTPDNPIVEAHAEENYMGDRYKWRSIKFDEMMNIEQGSISQNIDTKGVYYTSERPSVLVPDPVGTGIKGDGRNFEDIDFSQYPVNSQQIQSKEQFAQTCASRVACNPTVNRKIAEARFVNQTYSTYFIHTAMNYNSSDDKYYPRSPNMGYIFKELPQDNNVWTRPSGQEIVTYRGKVLGSFKEYQKYTPAQGDITLKANFADNTVSGTVTNRNGYKNNQDIVLIKTPISEQGTGRIGFSGGIQYGSYDANRGTDGSYEGIFVGPKAEEVVGFIDDTYRRGINGQQVFGASSK

SEQ ID NO: 795 - DNA, 1527 bp, G. anatis
atgagaaaatcaattaaattttctttacttgcattatgtataagtaatgttatcgcagtgaatacagtgtttgctgcagaacaaaatcaggaaaaatcaccttctcctaccctgtctaagcaacaacttattgctgaaattaatcaattaaataaggagatttcagcgaaagagaagacagcagtagcattaaataatcaaataaaagatttgcaaagtaaaattactaaggcaaaacaggacttacaatcaaaaatgaaggagcgtgatgctttaactaatagtttacaagctagcagtaaagaaaaagcacagctggaagaacaaattaaatccttaactgctcagttggctgatttacaaaagaaaattgatccaaaagtagtggagttagtagaacaaaaaaatacagcagaaactcagttaaaaaaagtaaatgctgatgtgagtagtaaaacaaaccaattaaatcaattaaccgcccaaattaaacaatcgacaacgaaagttgagcaactcaaagcacaaatcaaaccattagaaaaccaaataagcggtttaaattctcaagttaaacaacaacaagataaactcactaaaattgcagcagagcgaaaagcagtaacaacgaagattgcagaatatactaaaaatcaagagtgggtgaaaaagtatgaattagatagcaatggagtaagatggcgtgatctctattttgctcgcagtaattactcattctcaaaatcaaactttgctaaatcttctggaaattcttttccacgtcatattgaggtaattactgatgaattaggaaatcctaaactatctgaatttactaatactccaaccttacctctttctcaatataaagctaatcctagcaaaattaatgaagttctgattagttctgaacaaccagagaataaaggaaaagcggttggaaaagtcttttttgttaatcaaaatttctcttcttatgctgcttggcagcctatattagacagtaaatatagtggagataagggggaaagagttcaatctttaggttatggtttttcttaccctaattatgttgcccgtactgattatcaaaaaggcgttgatattaaatcgcaagcacaacagcgttatgaatctgtaaaagctaaaacgccacagattacatatcgtggatatatgctgaatgttggtggtaaatctggcgatattacattaactgccgatttagataaaaacgtggtgaatggcacagttacaaatagaatcgtaaatccagtacaggatggtcgagatttattattaaaaaatggtcaaatttctgtagatagagataggggaattatttttagtggaaaccaaggaagatctgttattcctgtaggaaataatccaaacaattcgccatttaaatatgcttattttgagggtacttttgctggtaaaaatatggaagaagtagtaggtacaatacataatttaccgagagagagcgcttcagcatttggtggtacacaggtaacaaaatag

SEQ ID NO: 796 - protein, 508 aa, G. anatis
MRKSIKFSLLALCISNVIAVNTVFAAEQNQEKSPSPTLSKQQLIAEINQLNKEISAKEKTAVALNNQIKDLQSKITKAKQDLQSKMKERDALTNSLQASSKEKAQLEEQIKSLTAQLADLQKKIDPKVVELVEQKNTAETQLKKVNADVSSKTNQLNQLTAQIKQSTTKVEQLKAQIKPLENQISGLNSQVKQQQDKLTKIAAERKAVTTKIAEYTKNQEWVKKYELDSNGVRWRDLYFARSNYSFSKSNFAKSSGNSFPRHIEVITDELGNPKLSEFTNTPTLPLSQYKANPSKINEVLISSEQPENKGKAVGKVFFVNQNFSSYAAWQPILDSKYSGDKGERVQSLGYGFSYPNYVARTDYQKGVDIKSQAQQRYESVKAKTPQITYRGYMLNVGGKSGDITLTADLDKNVVNGTVTNRIVNPVQDGRDLLLKNGQISVDRDRGIIFSGNQGRSVIPVGNNPNNSPFKYAYFEGTFAGKNMEEVVGTIHNLPRESASAFGGTQVTK

SEQ ID NO: 797 - DNA, 1293 bp, G. anatis
atgcatttgccaattaaaatttccagtcttgccctctttgttactttttcattaactgcttgcggtagctccggcggtggttctggtaattccaacaaaaatgaaactgtcgctaataatccacaaattgtgcaaaatgaaaaggcactacaaactcagttagagaagttgaaacagcaacagacaagaacccaaaaaaaccttgaagatgagcgtcaaaaattagctaaaaaagagaaagaattacaagatctcaaatcaaataatcaaatcgatcaagaaaaattatcttccctacaaaaagatctcgaacaaaacaaagcccgcgtttccagcctagaaaaaaccttatcagaacaacaaactgaagccgctcaagctcgccgtaatttagaagctcaacttgccgcagccaatagtgctttaaatgaaaaaagcaaagcactggaagatctgcaaaataaccagaatgccgatcaagcagcactacaaaaagcgcaaacagaattaaaagcaagccaaagtgaagtggaaaaactcaatcgacaacttgaggaattaaaacaattatatccacaagctgaatttgcaatgggtagcagggtaagaattgactctaaacactatagtaagttatctgaaagcctttctggactattacctaatactcaaaagatgactgatgagcaagttacacgaaatattttatttgctcccaaaatagctggaaaattaatgccacaagggcaaatccagcgtcatcaaatcactcaaaaagtaaatggcaaagacgtggaaatggattactttagctatcactataatgaagatgatacttatttagcagaagtatggagcgataactcacttggttacgtaagtgttgttgcctatggaggcaaagccacacctattgagaaattcgatgcattcaaacaggctcaagtagtgaaagagtatgatgtcaaaatggcaccgggaactggtcgttattgggatagctacgacacaacatttacagcagattttggcaacgaaaaaatttcaggtattgcgaaaaaaatcgatctcaacaatgcatttactgctaatgaagacattattttccctgaacagcctattttcgtaaaagatgatgctattcgctttggtggcaacaaacctagtgtaaaaataaagttcaagcatatggaagatacaatgaaatatgaaggaatatttatcggcgaaaatgctgaaaaaattgtagggcgagtagggggaagtagcctgattggtaaggaaaaagaataa

SEQ ID NO: 798 - protein, 430 aa, G. anatis
MHLPIKISSLALFVTFSLTACGSSGGGSGNSNKNETVANNPQIVQNEKALQTQLEKLKQQQTRTQKNLEDERQKLAKKEKELQDLKSNNQIDQEKLSSLQKDLEQNKARVSSLEKTLSEQQTEAAQARRNLEAQLAAANSALNEKSKALEDLQNNQNADQAALQKAQTELKASQSEVEKLNRQLEELKQLYPQAEFAMGSRVRIDSKHYSKLSESLSGLLPNTQKMTDEQVTRNILFAPKIAGKLMPQGQIQRHQITQKVNGKDVEMDYFSYHYNEDDTYLAEVWSDNSLGYVSVVAYGGKATPIEKFDAFKQAQVVKEYDVKMAPGTGRYWDSYDTTFTADFGNEKISGIAKKIDLNNAFTANEDIIFPEQPIFVKDDAIRFGGNKPSVKIKFKHMEDTMKYEGIFIGENAEKIVGRVGGSSLIGKEKE

SEQ ID NO: 799 - DNA, 666 bp, G. anatis
atgggggcaactttggataacccatggctgatggaaaaacctattaaccacgatcaattatctcaaaaccaattgtatatacagcctgtaatggctctttatcctttaggcgaggatagtgaagggatgttggttggtgatagatatctttataaacaacaatattctgttgtttatgctaaaaattggttagcttctttgcctgatggcgttttatcaaaaggagggcgtttctctgttaatggcattggtaacttatttgaagatgaaccgacaattctcccaagtgaaggttcagcaacgtatcgaggaaaagcatttaatgcgaacaatatgggagatttaacttatcgtgttgattttgaacagcgaacgggtcaaggggaaatcactaatttttcaaataatataggtcatattaccttacatcaaggctcaattaatgatcaggaaattaaagctgatgcatcaatggcaggcggaattacaggaaaatatacgctaggtttttttgggccaaatggggaagaaattgctggtgatctttatattgatagctcgttagacaatagtattcctgctaacggaggcacacgaaaaaaatatgaggcaaaaaatagaggcgtagcatttggtttagcagctcaaaaagaatcacaacagtag

SEQ ID NO: 800 - protein, 221 aa, G. anatis
MGATLDNPWLMEKPINHDQLSQNQLYIQPVMALYPLGEDSEGMLVGDRYLYKQQYSVVYAKNWLASLPDGVLSKGGRFSVNGIGNLFEDEPTILPSEGSATYRGKAFNANNMGDLTYRVDFEQRTGQGEITNFSNNIGHITLHQGSINDQEIKADASMAGGITGKYTLGFFGPNGEEIAGDLYIDSSLDNSIPANGGTRKKYEAKNRGVAFGLAAQKESQQ

SEQ ID NO: 801 - DNA, 2013 bp, H. aegyptius
atgaacttaaaaaactctaacttgacattattacaaaaaaagaacaataatgcgaattattatcaattttgtataagtattaattctatgaaatctgtacctcttatcactggtggactttcctttttactaagtgcttgtagcggaggagggtcttttgatgtagatgacgtctctaatccctcctcttctaaaccacgttatcaagacgatacttcaagttcaagaacaaaatctaatttgaaaaagttgtccattccttctttagggggagggatgaagttagtggctcagaatcttcgtagtaaggaagaacctagtctcttaaatgaaaatgactatatatcatatttttcctcactttctacgattaaagctgatgttgaaaaagaaaataaacgccatacaaatccagttggctcaatagacgagcctagcgcaacacatccaaccgaaaatcgtcatggacaaaaatatgtatattcagggctttattatattcaatcgtggaatttaaacgatcctaaaaataacaagctttatttaggttactatggatatgcgttttattatggtaatcaaactgcaacaaacttgccagtaaacggtgtagctgaatacaaaggaacttggaacttcatcactgcaactaaaaatggcaagacttatgaattgttgagaaattctggcggtcaagcttattctcgacgtagtgctactccagaagatattgatttagaaaacggtgacgcgggcttaacaagtgaatttagtgtagattttggtacgaaaaagctcactggagaactttattataataaaaggaaaacagagcttaataaagatgaaaatagaaaacataaactctatgatatagatgccgatatttatagtaatagattcagaggtaaagtaaagccaacaaccccaaaagattctgaagaacatccctttaccagcgagggaacattagaaggtggtttttatgggcctaatgctgaagaactagggggaaaatttttagctggcgataaccgagtttttggggtatttagtgccaaagaaacggaagaaacaaaaaacaaagcgttatccaaagaaaccttaattgatggcaagctaattactttctctactaaaaaaaccgatgcaaaaaccaataaaacaaccaatacaacaaccgatgtaaaaaccgatgaaaaaaactttacgacagaaaatatatcaagttttggtgaagctgattaccttttaattgataattaccctgttcctcttttacctgaagaaaaaactgatgacttcgtaacgagtaaacatcacgatattggaaataaaagatataaagtagaagcatgttgcaagaatctaagctatgtgaaatttggtatgtattatgaagacccattaaatggagaaaatggcaaagaaaaacaaaaagacaaagaagaaaaagacaaacaaacgacaacatctatcaagacttattatcaattcttattaggtcaccgtactcccagttctgaaattcctacaatgggaaacgtgaaatatcatggtagttggtttggttatattggtgatggtacaacatcttattccactacaggaaataaacaacaaaataacaatgctgtcgccgagtttaatgtaaattttgccgataaaaagctaacaggcgaattaaaacgacacgataatggaaataccgtatttaaaattactgcagaccttcaaagtggtaagaatgacttcactggtacagcaaccgcaacaaattttgtaatagatggtaacaatagtcaaactaaaagtaccccaattaatattacaactgaagtaaatggggcattttatggaccgaacgctacagaattaggcggttatttcacctataacggaaattctacagctaaaaattccccagccgtaccttcaccacccaattcaccaaatgcaagagctgcagttgtctttggtgctaaaaaacaagtagaaacaaacaacaagtag

SEQ ID NO: 802 - protein, 670 aa, H. aegyptius
MNLKNSNLTLLQKKNNNANYYQFCISINSMKSVPLITGGLSFLLSACSGGGSFDVDDVSNPSSSKPRYQDDTSSSRTKSNLKKLSIPSLGGGMKLVAQNLRSKEEPSLLNENDYISYFSSLSTIKADVEKENKRHTNPVGSIDEPSATHPTENRHGQKYVYSGLYYIQSWNLNDPKNNKLYLGYYGYAFYYGNQTATNLPVNGVAEYKGTWNFITATKNGKTYELLRNSGGQAYSRRSATPEDIDLENGDAGLTSEFSVDFGTKKLTGELYYNKRKTELNKDENRKHKLYDIDADIYSNRFRGKVKPTTPKDSEEHPFTSEGTLEGGFYGPNAEELGGKFLAGDNRVFGVFSAKETEETKNKALSKETLIDGKLITFSTKKTDAKTNKTTNTTTDVKTDEKNFTTENISSFGEADYLLIDNYPVPLLPEEKTDDFVTSKHHDIGNKRYKVEACCKNLSYVKFGMYYEDPLNGENGKEKQKDKEEKDKQTTTSIKTYYQFLLGHRTPSSEIPTMGNVKYHGSWFGYIGDGTTSYSTTGNKQQNNNAVAEFNVNFADKKLTGELKRHDNGNTVFKITADLQSGKNDFTGTATATNFVIDGNNSQTKSTPINITTEVNGAFYGPNATELGGYFTYNGNSTAKNSPAVPSPPNSPNARAAVVFGAKKQVETNNK

SEQ ID NO: 803 - DNA, 891 bp, H. influenzae
atgaaacttaatctttcgaaattcagcttaactattcttacaacggtaatgctggcttcctgtggaagtggcggcggtgataatactcaattagtaagtccaccaaaaccagctgagcaatccaaaccggctgagcaatcgaaaccagctgatcaatcaaaatcagttgaacagtcaattcttggaatgcctgaacgcttgccaactaataccggtttagcattttctataaaaacagaagatgagggaaatattaatacaattaagaatgaacaggagctcattgctactaataattttgctagtatcaatgttgatggcaaaaatatccctattgattttaaattagaaccaagtcaaggttggacaaaagaaggtgcgtttatcgaagagctgaatttagcaccacatatttgttgtggaaaatacacagatgtccgctttggtgcaattgcaagtcattcatttgggcaagatgatattcttttttataatggaaatccttcaaacagtgtgccagaatcaggagaagttacttacaagggtgaaagtataatggcggataaaggcaatagcgtatttggtggttatagaaaaggcacctctgaatttaaggttaattttggtgacaaaaaattatcaggaagtttaaacgttgatagtcctaaatatgatgttgaatctggagaaagtaaatttaataaagtcaaagttgacattaatgccgatatttcaggcaataaattttacggcagtgcaaaatcttcctcttttgtttcagaagctgtatcagagggcaagttttatggggatggagctaaagaactaggtggaatggtaaaagctaaagataattcttgggttggagcctacggtgcaaaagcacagtaa

SEQ ID NO: 804 - protein, 296 aa, H. influenzae
MKLNLSKFSLTILTTVMLASCGSGGGDNTQLVSPPKPAEQSKPAEQSKPADQSKSVEQSILGMPERLPTNTGLAFSIKTEDEGNINTIKNEQELIATNNFASINVDGKNIPIDFKLEPSQGWTKEGAFIEELNLAPHICCGKYTDVRFGAIASHSFGQDDILFYNGNPSNSVPESGEVTYKGESIMADKGNSVFGGYRKGTSEFKVNFGDKKLSGSLNVDSPKYDVESGESKFNKVKVDINADISGNKFYGSAKSSSFVSEAVSEGKFYGDGAKELGGMVKAKDNSWVGAYGAKAQ

SEQ ID NO: 805 - DNA, 1686 bp, H. influenzae  (TbpB)
atgatattttcctcacgttctacgattgaagaggatgttaaaaataacaatcaaaacggggagcaccctattgactcaatagtcgatcctagagcaccaaattcaaacgaaaatcgtcatggacaaaaatatgtatattcagggctttattatattcaatcgtggagtctaagagatttaccaaataaaaagttttattcaggttactatggatatgcgtattactttggcaatacaactgcctctgcattacctgtaggtggcgtagcaacgtataaaggaacttggagcttcatcaccgcagctgaaaatggcaagaattatgaattgttaagaaattctggtggcggtcaagcttattctcgacgtagtgctactccagaagatattgatttagatcgtaagacgggcttaacaagtgaatttactgtcaattttggtacaaaaaagctcactggaggactttattataatttacgtgaaacagatgctaataaatcacaaaatagaacacataaactctacgatctagaagctgatgtacatagcaaccgattcaggggtaaagtaaagccaaccaaaaaagagtcttctgaagaacatccctttaccagcgagggaacattagaaggtggtttttacgggcctgagggtcaagaattaggaggaaagtttttagctcacgacaaaaaagtttttggggtatttagtgccaaagaacagcaagaaacgtcagaaaacaaaaaattacccaaagaaaccttaattgatggcaagctaactacttttaaaacaaccaatgcaacagccaatgcaacaaccgatgcaacaaccagtacaacagccagtacaaaaaccgatacaacaaccaatgcaacagccaatacagaaaactttacgacaaaagatataccaagttttggtgaagctgattatcttttaattgataattaccctgttcctcttttccctgagagtggtgatttcataagtagtaagcaccatactgtaggaaagaaaacctatcaagtagaagcatgttgcagtaatctaagctatgtaaaatttggtatgtattatgaagccccacctaaagaagaagaaaaagaaaaagacaaagacaaagacaaagacaaagaaaaagaaaaacaagcgacaacatctatcaagacttattatcaattcttattaggtctccgtactcccagttctgaaatacctaaagaaggaagtgcaaaatatcatggtaattggtttggttatattagtgatggcgagacatcttactccgccagtggtgataaggaacgcagtaaaaatgctgtcgccgagtttaatgtaaattttgccgagaaaacattaacaggcgaattaaaacgacacgatactcaaaatcccgtatttaaaattaatgcaacctttcaaagtggtaagaatgacttcactggtacagcaaccgcaaaagatttagcaatagatggtaaaaatacacaaggcacatctaaagtcaatttcacggcaacagtaaacggggcattttatggtccgcacgctacagaattaggcggttatttcacctataacggaaacaatcctacagataaaaattcatcatccaattcagaaaaggcaagagctgccgttgtgtttggagctaaaaaacaacaagtagaaacaaccaagtaa

SEQ ID NO: 806 - protein, 561 aa, H. influenzae  (TbpB)
MIFSSRSTIEEDVKNNNQNGEHPIDSIVDPRAPNSNENRHGQKYVYSGLYYIQSWSLRDLPNKKFYSGYYGYAYYFGNTTASALPVGGVATYKGTWSFITAAENGKNYELLRNSGGGQAYSRRSATPEDIDLDRKTGLTSEFTVNFGTKKLTGGLYYNLRETDANKSQNRTHKLYDLEADVHSNRFRGKVKPTKKESSEEHPFTSEGTLEGGFYGPEGQELGGKFLAHDKKVFGVFSAKEQQETSENKKLPKETLIDGKLTTFKTTNATANATTDATTSTTASTKTDTTTNATANTENFTTKDIPSFGEADYLLIDNYPVPLFPESGDFISSKHHTVGKKTYQVEACCSNLSYVKFGMYYEAPPKEEEKEKDKDKDKDKEKEKQATTSIKTYYQFLLGLRTPSSEIPKEGSAKYHGNWFGYISDGETSYSASGDKERSKNAVAEFNVNFAEKTLTGELKRHDTQNPVFKINATFQSGKNDFTGTATAKDLAIDGKNTQGTSKVNFTATVNGAFYGPHATELGGYFTYNGNNPTDKNSSSNSEKARAAVVFGAKKQQVETTK

SEQ ID NO: 807 - DNA, 738 bp, H. influenzae
atgaaaataacatttactagatcattattagcaacagccgtaatggtgggattaactgcttgtggttcaggtggtggtaatggtatgaataacaatacaactagtcaagttacaggaaaaacgggcgcaatgtatacagtttcattaactaatgataataaaatagggacggttacgaaaactccattaaataattctgatattaattctcttaatttagatagcgcatcaacacaacgtattaatgaagctatgaataaaatttcagaggaatttaaatcaaaaacaggattagatgttgttactggagctgcaattgtttctaatggagaaaagtttcatattatctataacggtaatccaacagaaacaatgccagtacaaggttcaatccattataaaggttctgccgttttagggggatggtctgcggatgctccactctcaattgaaaaaggaacctctcaatttgatgtgaattttgctgataacaccttaactggaacattaaatgttccgaatttttctcttgtttccatatcagctagcgtgtcaggaaacagtttttctggtcgagcaacatcccctgatgctcctgatggtgctgtcgtagagggaaaattttatggaaaagatgctcttggtttatcaggaatgttaaaaacaaatacatttacagataattttggtggagcggggatctttagtgctattgatgaaacgaaaataacacaataa

SEQ ID NO: 808 - protein, 245 aa, H. influenzae
MKITFTRSLLATAVMVGLTACGSGGGNGMNNNTTSQVTGKTGAMYTVSLTNDNKIGTVTKTPLNNSDINSLNLDSASTQRINEAMNKISEEFKSKTGLDVVTGAAIVSNGEKFHIIYNGNPTETMPVQGSIHYKGSAVLGGWSADAPLSIEKGTSQFDVNFADNTLTGTLNVPNFSLVSISASVSGNSFSGRATSPDAPDGAVVEGKFYGKDALGLSGMLKTNTFTDNFGGAGIFSAIDETKITQ

SEQ ID NO: 809 - DNA, 570 bp, H. parahaemolyticus
atgtttaaaaaatcgtttattttcgcattaccattcatagtaaccgcttgctcttccaacaatcaaacagaagaggcatttccaggtcaatttgctgatgcagattatgtcctttctgaccaagatgcacaaaaatgggtggcagaaagcgaacaggctcgtcaatgtatttatccaaatttgacccgtattcaacaaaatcatttttcaaaagaagatagctatatccatgcccaatatgttttcttctacccgcttgaaaaagtcattggcgagcagtatgtaaatattttgcaggcagacgaaaaatccatgggctatgcacaatatcaattcaaaaaatttaaagataagcccaccgagatccaacctctaacagcccagcaatgcgaaacactgcgagcacaagcccgcgatgatttagcggtcgttaaagggcaatacaaaagtggcatggtggaagaaacgaaaaccgcaagcgacgacaagaaaaacagcgatggcgttgccaccaaccaaaataaattcttctttgatattatcaaatggggatcggcgttgttgctctaa

SEQ ID NO: 810 - protein, 189 aa, H. parahaemolyticus
MFKKSFIFALPFIVTACSSNNQTEEAFPGQFADADYVLSDQDAQKWVAESEQARQCIYPNLTRIQQNHFSKEDSYIHAQYVFFYPLEKVIGEQYVNILQADEKSMGYAQYQFKKFKDKPTEIQPLTAQQCETLRAQARDDLAVVKGQYKSGMVEETKTASDDKKNSDGVATNQNKFFFDIIKWGSALLL

SEQ ID NO: 811 - DNA, 876 bp, H. parahaemolyticus
ttattgtttatataaagtttgagagccgattatttctatatttttatcagatgaagatacatcatatttgaagtatatatcatctccatcatatcgattagtttcacctccatatgaacctgataagttttctgtttttaacgtttctgtcaggattttacccgttgcctcactattaaatgctacgcgattatcatttttatagagagcagcctctttaaattcaagttcagcttgagcttttttcacatcatctgatgaataaaaattaaagactgcagaaccgttgatttttttattatcaaaatcagcatttaagataacataactttttccatcgacttttgaagaaatattgttaccattaatttttgcactagcatctatattctgagaaagataggttgctttgccttttaaattagagccataaccagatattgaagactcttcaaattttggtactgcaggcaatttatcccaaaccacttcttttggcgtattttcagttgtaggagttacaacaggaactgtaattgtttctgaaggtttagcaggttcaactgtaggtgttgttgctgtttccgaaggtttagcgggttcaacgtttggagtcgttgctgtttccactggtttagcgggttcaacgtttggagtcgttgctgtttccgtaggtttagcaggttcaacttttggggttgttggttgttctctttgaacttcagaaactttttcgccattaaatacaccatttgatgtattcgttgatgaattagtggctccattattaccgctattaccaccacctgaaccacaagcagttaatcccaccattacggctgttgctaataatgatctagtaaatgtcattgtcat

SEQ ID NO: 812 - protein, 291 aa, H. parahaemolyticus
MTMTFTRSLLATAVMVGLTACGSGGGNSGNNGATNSSTNTSNGVFNGEKVSEVQREQPTTPKVEPAKPTETATTPNVEPAKPVETATTPNVEPAKPSETATTPTVEPAKPSETITVPVVTPTTENTPKEVVWDKLPAVPKFEESSISGYGSNLKGKATYLSQNIDASAKINGNNISSKVDGKSYVILNADFDNKKINGSAVFNFYSSDDVKKAQAELEFKEAALYKNDNRVAFNSEATGKILTETLKTENLSGSYGGETNRYDGDDIYFKYDVSSSDKNIEIIGSQTLYKQ

SEQ ID NO: 813 - DNA, 948 bp, H. parainfluenzae
atgtcttctttaaatcatatttttaaatttggtacaacagcattagctgctttagtattatctgcgtgtggtagcagcggcggtggtagtgatgactcaaatgtttcagttccaaccaataaaactgagcaaactcagccaagcactactgtcaataatacgactcagcaaccaagtactactgccaataatacgactcagcaatcaagtactactacgtctacaaataatcagacaacaccaagccaatctactccagctgaaaatgtagctcaaccatcaacccctaatactcaaagtggtaatactaatcgagcactcacagataaacatgttggtttcatcatacctaaaaaaggcggaactattcaaaccgcatccatttctggcaatccaaatctttatgtgctagatgttgaaggtaaaagtattaatataattcctgccgggatggggggtggaaaggttctcaaaatcacggccaacaatattacccgcatagttaacggttcattatataaaaatgtacgttggggattaattacagaggatggcttaaataattattacttagtctcttacggtatcaatcctacaaccaacatgccaactagcggtagcgctacctatgtaggacaaggtgtacacggttatgcagatagtggttcagctattgatacgtatcgcttaagtaacgcaaaatttaatgtaaattttgctgataaatcatttgaaggctctattactccagatgatggaaaagcatttggcaatatcaacgcggttaaactttctgcgaaaattgatggtaaccaatttaacggtaaaactgctgaaggtacagaagctgtcggtcgtttctacggaaataacgctagtgagttagctggtagctatgtaaatgaaaaagcctcttaccttggggtattcggcgctcaaaaacaataa

SEQ ID NO: 814 - protein, 315 aa, H. parainfluenzae
MSSLNHIFKFGTTALAALVLSACGSSGGGSDDSNVSVPTNKTEQTQPSTTVNNTTQQPSTTANNTTQQSSTTTSTNNQTTPSQSTPAENVAQPSTPNTQSGNTNRALTDKHVGFIIPKKGGTIQTASISGNPNLYVLDVEGKSINIIPAGMGGGKVLKITANNITRIVNGSLYKNVRWGLITEDGLNNYYLVSYGINPTTNMPTSGSATYVGQGVHGYADSGSAIDTYRLSNAKFNVNFADKSFEGSITPDDGKAFGNINAVKLSAKIDGNQFNGKTAEGTEAVGRFYGNNASELAGSYVNEKASYLGVFGAQKQ

SEQ ID NO: 815 - DNA, 1548 bp, H. parainfluenzae
atgaaaaacaacaaacttgttaaatttagtctaacattaatctgttcagctgtattagcagcttgtggttcaagtggcggtagcgataattcagccgctcaacaacaagctcaacaacaagctcaacaacaagcaaaagcagcagctgagaaagcagcagcagaaaaagcagcagcagaaaaagcagcagcagaaaaagcagcagcagaaaaagcagcagcagaaaaagcagcagcagaaaaagcagctcaaacaacttctagcgagtctaacccaggttacttactttctaaaaagaacgcatctgatttcatcgtaaataaaaatggtgataaagttgactctactcaatctgctccattgccaatgactgttcaaaatttagagcctcgtctagatactatcgttgtagcttacccacacgaaggtgctgagtctaaagcgattgcttatattgaagatttccaatttgttggtaatgacaaacaagatggtaaatttactttaactggcatttataacgactcaatagatcgtagtactactggtggcactccacgtccagaaagccgtactaaaactgatacacaaggtacagagtctggtgctgctttagtttacgaaaaagatcgtattgcttactttgaccgtgcagacagaaatgctgagggtaaagatacattagctgaagtttacggtttaagaaccaattcctatgaagatggtaaagaattaaaagatactgatgcaaataacctaccattagtaaaagaaactaataaattagctgctcaacaagatggtcaattacgttttgttcaatatggtcgtgtaacaactaaattacatgaccttactgaaaaagatctaaacgtatacaaaaaaggtctattggacgataaaaacagtaacgtaacaagtaacgttattggttttgctaactatggtgaagcaggtactgaaaactcttacttctatcgtggtttaaacaatactactggtgaacaattagctaaactttctggtgagcttgtataccacggtcacgcagtagcttatggcttaaacaatgactaccgtccgggtgaagctaataaaactggcgcgccaaatgctatcggtgtagaaaaagaagttgacgcactaaaaagtggttaccatgttttggctaaagttaacttagcagataaaaatgttactggttctatctataacacttggaataacgacaaaaaaggtgactacaatgttgatttagttaactttaatggtaagttagacaactacggtaacatcgcaggtacttctgcattagcatacgaagatgcaaataaagacggttcatttaacgcaactttatttggttctcaagcatctgagttaggtggtaatgttgcaggtagcaaaaatgctgataccactgtaacacaatggggtgcggtatttggtgctaagaaatatgaagaagctgtatcaacaccagaaaaaattgttaataaaccttgggcggctcgtgctgacgaaaatactgctggtcaagtaaaataa

SEQ ID NO: 816 - protein, 515 aa, H. parainfluenzae
MKNNKLVKFSLTLICSAVLAACGSSGGSDNSAAQQQAQQQAQQQAKAAAEKAAAEKAAAEKAAAEKAAAEKAAAEKAAAEKAAQTTSSESNPGYLLSKKNASDFIVNKNGDKVDSTQSAPLPMTVQNLEPRLDTIVVAYPHEGAESKAIAYIEDFQFVGNDKQDGKFTLTGIYNDSIDRSTTGGTPRPESRTKTDTQGTESGAALVYEKDRIAYFDRADRNAEGKDTLAEVYGLRTNSYEDGKELKDTDANNLPLVKETNKLAAQQDGQLRFVQYGRVTTKLHDLTEKDLNVYKKGLLDDKNSNVTSNVIGFANYGEAGTENSYFYRGLNNTTGEQLAKLSGELVYHGHAVAYGLNNDYRPGEANKTGAPNAIGVEKEVDALKSGYHVLAKVNLADKNVTGSIYNTWNNDKKGDYNVDLVNFNGKLDNYGNIAGTSALAYEDANKDGSFNATLFGSQASELGGNVAGSKNADTTVTQWGAVFGAKKYEEAVSTPEKIVNKPWAARADENTAGQVK

SEQ ID NO: 817 - DNA, 694 bp, H. paraphrohaemolyticus
ggaataccaagcaggattattaaaagcacaatcaataaaagaaacaaaaatagggcaggcacttccttatcacttaggcaataatgaaatcggatatattgatcgtagcaaacaaagcatatctcaagatggtaaattaactaaattttctggaggaacatatatttataatcaaccctactctattgttattgcaaatactgaaagtgagaatattcaaaatgatgttgatttaacacctgaatggtatgcttatgatgtggatgttgcaggtttagcaaccgaggagaaaaatattccaacgaatggaaaagccacctatatggggcaaggattttttaatggagctaccgcaacatttatatataacgtaaattttaatattaaaaaaggtcaaggtagattaactgaaatgggcggctcaggaaaattaaccttacaagaagcagatattaagcgtattaatttaaaaggtaataatattattggcgtagaaggaaaagcagaatcatcttataatcatttagttgatggtcactatcaattaggattctttggtcctaatgcagaagaagtttctggtttagcaactttctctatggaagaaaagagaaaaacagctggaacaacaaaaaacgatcataataaatttgagtttggtttaggtggcacccgcggtgaaattcaaaaataa

SEQ ID NO: 818 - protein, 230 aa, H. paraphrohaemolyticus
EYQAGLLKAQSIKETKIGQALPYHLGNNEIGYIDRSKQSISQDGKLTKFSGGTYIYNQPYSIVIANTESENIQNDVDLTPEWYAYDVDVAGLATEEKNIPTNGKATYMGQGFFNGATATFIYNVNFNIKKGQGRLTEMGGSGKLTLQEADIKRINLKGNNIIGVEGKAESSYNHLVDGHYQLGFFGPNAEEVSGLATFSMEEKRKTAGTTKNDHNKFEFGLGGTRGEIQK

SEQ ID NO: 819 - DNA, 1401 bp, H. parasuis; identical to SEQ ID NO: 219

SEQ ID NO: 820 - protein, 385 aa, H. parasuis
MRLSVKTAAMAILVSLGVTACSSGGGGGGSSAPANNPEQAKQIEALKKQVEAEQQAVKNAEAATAAEQAKAQAAAEKAAQDLAKAQEAVRNAEAATAAEQAKAQAAAEKAAQDLAAAQNQISALEAELAPVREEAERKRQEAEAEEKKWEFLKDGNAWRYVEKSSYDNNSIVYGGEDKVGQLVLQNQAKHWALQKAVNFNESGISDNVSTLPIYATRKTLSGDKEVQVANAHFVNQQYSTYINWSYNPDLLTNDDVHRTATYIALPTTTNSDYLKSATTATYSGKAIKRNWDDNLISTGDFSLTANFQTEKVTGAITNLDGRDYVFNEGNISVSPKNNLIFSGIVDMTGLYGGINTNYKGVFAGPNAEEVVGTAGNRVSFGGKRQ

SEQ ID NO: 821 - DNA, 1641 bp, H. parasuis
atgcattttaaacttaatccctatgcgttagcgtttacttcgctgtttattgtcgcttgttctggcggaaaaggaagttttgatttagaagatgttcagcctaataagacaacgggcgtgtctaaagaagagtatcaggatgtggaaaccgataagaaagtaaaagaacagttaggggaattgatggaacctgctttggggtatgttgtaaaggttccggtgagtcaaagtggagcaagaagaacggaaatctcaaatccagaagcaattactgatgaagatcttaataaaataccaaatcacgagactatcaaaagtgtagctgatcaaaattatggctgggtagtagataaaacagcagataaaacgatgaagtatgttcgttctggttatgcaattgatgtagatcattatggtactcgtgataaaggttatgtgttttataaaggcatcactccctcaaaagaattaccgcagggaccagtccttacctatcaaggtgaatgggattttacctcggatgctaatttagatgccaaaagacctaatagtaaccctgaatttaatgggtatggtccagggcagagaattgcaacaacatctgcaaatgctaaaggtagaacctatacatctgaatttgaagttgatttttcaacaaaaaaattaaaaggaaaattaaatagcaaaacagcaaatgcagaatcattagagcgttacagtattgaagcagaacttaaaggaaatcgttttagaggtaaagcaatagccaagaatgatagcgatgcaattttaggtaagtcttctgattatcttgaaggtggtttctatggacctaaggcagaagaacttgcaggaaaatttattacaaacgacaaatctctttttgccgttttttcagcaaaacacaatggctctaatgttgacacagttcgtattattgatgcctcaaaaattgatttaactcattttaattcttcagaacttaccaattttggcgatgcttccgttttaattattgatgggaaaaaaatggatctggcaggtagcgagtttaaaaataagcacattgttgaaatcaacggtaaaacaatggtagcagtagcttgctgtagtaatttggaatatatgaaatttggtcaattatggcagcaaacagagggcgaaaaagccaaagataatagtttattcctacaaggcgaacgtactgcaacagataagatgccaaaaggcggaaactataaatatattggtacttgggatgctcaggtttcaaaagaaaataactgggttgctacagcagatgatgatagaaaggctggctatcgcacagaatttgatgttgatttcggcagcaaaaatttaagcggtaagttatttgataaaaacggtgtaaatcctgtgtttaccgtagatgcaaaaattaatggtaatggttttactggaaaagctaaaacctcagatactggcttcgctctagactcaggcagttcacgttatgacaatgtgaaatttagcgatgtagcagttaatggtggcttctatggtccaacggcagcagagcttggcggacaattcttccataaatcagacaatggcagtgtaggtgctgtctttggtgcaaaacaacaagtaaaaaaataa

SEQ ID NO: 822 - protein, 546 aa, H. parasuis
MHFKLNPYALAFTSLFIVACSGGKGSFDLEDVQPNKTTGVSKEEYQDVETDKKVKEQLGELMEPALGYVVKVPVSQSGARRTEISNPEAITDEDLNKIPNHETIKSVADQNYGWVVDKTADKTMKYVRSGYAIDVDHYGTRDKGYVFYKGITPSKELPQGPVLTYQGEWDFTSDANLDAKRPNSNPEFNGYGPGQRIATTSANAKGRTYTSEFEVDFSTKKLKGKLNSKTANAESLERYSIEAELKGNRFRGKAIAKNDSDAILGKSSDYLEGGFYGPKAEELAGKFITNDKSLFAVFSAKHNGSNVDTVRIIDASKIDLTHFNSSELTNFGDASVLIIDGKKMDLAGSEFKNKHIVEINGKTMVAVACCSNLEYMKFGQLWQQTEGEKAKDNSLFLQGERTATDKMPKGGNYKYIGTWDAQVSKENNWVATADDDRKAGYRTEFDVDFGSKNLSGKLFDKNGVNPVFTVDAKINGNGFTGKAKTSDTGFALDSGSSRYDNVKFSDVAVNGGFYGPTAAELGGQFFHKSDNGSVGAVFGAKQQVKK

SEQ ID NO: 823 - DNA, 771 bp, H. pittmaniae
atgaaaaaattaatcttaaaatttggaattacagccctgaccgcatttacgttggttgcttgtagtagcggtggtggtagcgatagtgcacctgcgccggcggcaccacaagccaataacaacgcagcacagaatcaaccccagccaaatccggctcaaaataatccggttcaatcagtgccagccgtggcctcttatagtttatctggtgacaaattatcggtgaccggttctggtattaatcgaattactgttgaagggcaagaattagatctgacctatgatgcgaatccagccactatttggagcagtaaaagtggcctatcttgctgtagtaaattcactgatgtgcgtgtcggtgctggaagaattggggatttagtcaattttaaagatgtcgtgttctataccggtaacgaaactcaaactatgccggaaagcggtgttgtaacttataacggctatggattgattcatagagtggctgctccaggatacactacagatgatgctcaaggctatgcaacctttactgcagattttaatactaagaagctgacaggttcttttggtaatgcagatgtggaatatgaaaccgtgagtatcgatgcagcaattagtggcaatggtttctccggtacagcaaattctccgcagttaggtcaaggtaaaaccgaaggtaaattctatggtgagaatgccaaagaattgggcggtgttgtattgggtgatgataaaacttgggctggtgctttcgcagcgcaacaataa

SEQ ID NO: 824 - protein, 256 aa, H. pittmaniae
MKKLILKFGITALTAFTLVACSSGGGSDSAPAPAAPQANNNAAQNQPQPNPAQNNPVQSVPAVASYSLSGDKLSVTGSGINRITVEGQELDLTYDANPATIWSSKSGLSCCSKFTDVRVGAGRIGDLVNFKDVVFYTGNETQTMPESGVVTYNGYGLIHRVAAPGYTTDDAQGYATFTADFNTKKLTGSFGNADVEYETVSIDAAISGNGFSGTANSPQLGQGKTEGKFYGENAKELGGVVLGDDKTWAGAFAAQQ

SEQ ID NO: 825 - DNA, 750 bp, H. pittmaniae
atgaagaaaaatctcctaaagtttggctttagtgttcttgccgcatttaccttagctgcttgtagtagcggtggtggcaatgatggtgatcctgtaccgcaagccaataataatgcagtacaaacgcagaccccgtctaaccagaaccaaaccggtcaagataatactaatcaaccatctactgcagctgcagtagcttataccacaagcggtaaaaaattatcgacaagcggttcggggattaatagtattgtggttaatggacaaactttacgtttggttcatccgaacctttatgccggtacctggcaaaacttgaacggccaaaacgtttgttgtggtaagtttagcgatgtgcgtgtaggtgcgtctaaggtgaatggtgaagatgttgtgttctacaccggtaatgctactcagtctatgccaaataatggtgtggcaacctataaaggctatgctgctattcgtgatgcatctggtttgcatacagcctccgcagaaaataccgcagtatttaccgcagattttgcagcgaagaaactaacaggttcctttacggcggatagtaaaacggtaaatgttgatgcggcaattgatggtaatggattctctggcacggcgaactcagctcaattaggccaaggtaaagcggaaggtaaattctatggtaacaacgccaaggaattaggcggtcttgcacagggtaatgataattcttggagtgcagtctttgcggcacaacaatag

SEQ ID NO: 826 - protein, 249 aa, H. pittmaniae
MKKNLLKFGFSVLAAFTLAACSSGGGNDGDPVPQANNNAVQTQTPSNQNQTGQDNTNQPSTAAAVAYTTSGKKLSTSGSGINSIVVNGQTLRLVHPNLYAGTWQNLNGQNVCCGKFSDVRVGASKVNGEDVVFYTGNATQSMPNNGVATYKGYAAIRDASGLHTASAENTAVFTADFAAKKLTGSFTADSKTVNVDAAIDGNGFSGTANSAQLGQGKAEGKFYGNNAKELGGLAQGNDNSWSAVFAAQQ

SEQ ID NO: 827 - DNA, 1965 bp, H. somni , TbpB
atgacctctttcaaattattaggcttttcggtcttgagtgtggctttgctctctgcctgctcttccggcaaaggtggctttgatttagacgacgtcgagcatacccccccctcctcctcgggtagttcccgccccacttatcaagatgttccgactggacaacggcagcaagaaatagtagaagaaatcaactcacctgctctaggttatgcgacagaaattccgcgtaggaatatttcgccaatgcccaccacgggcacaaaagaaagtaatgctcgtgttgccattactgcccagcaagttgccccccttagcatgccttttaattcaataaaagaagattttatcaaaaggctaatagcagaaaacaccaagaaaaatgcacgaggtagagatgtaaaatattttgatgatacagatgacgtgttgtttgcacatgatggatctaatttagcgcataaacgtgatttacaatatgttcgagttgggtatgtgttgggtacccgaaagattgaacttgttttttcccatgataaaaaaacaagagatcaatttcctgctggttgggtaggttatgttttttaccaaggcactagccctgcggttacattacctacacaaaccgtaacatacaaaggctattgggattttgttagtgatgccttcaatgaacgaactttagctgaagattttacacaggaaaatagttctgctactagcaatataccgggcaatcaaatcggtgcgacttcaatggatgcattggttaatcgcaaagtttcaggagaaaaaatcaatattgctcacagtgctgagtttactgctgattttggcagtaaaaaactttcaggtgaattaaaaagtaacggttatgtttctagaaaagaaaatgatcaagatgtaaaaacacgctataaaattaatgctgatatcaaaggcaaccgttttgtcggttcggcaacgtcaacagcgaatggacacaccatcttcggcaaggatgcggacaaacgtctcgagggagggttctttggtcccaaagccgaggaactggcagggaaattcctgaccaatgataattccctgtttgttgtctttggtgcaaaacgtgaaagtaaaggcgatgaaaaactagaaacccgctttgatgccgttaaaatcagcacggatagtaataaattagaaaaagaaacgatggatacgttcggcaatgccagctatttagtgttggacggcagacagtttcctttggtgccggaaagtaatgccggtacgacgggcgctggcaacacaggcaagaatgatttcatcaccaccatagacggtaaccaattaagcaaaacaaaccatgataagcacaaaaactacaaagttaccgtatgctgcagtaatttgcaatatgtgaaattcggcagctatggggaacaaacaacagcaactacgcataacggcacatcaactagccaattaacaaacggacaccttttcctaaccggtgaacgcacttcgcttgccgatatggagaaggaaaaaggcacagcaaactaccgtggcacttggcaggctaatttttcaagtaatgacggcagagtaagtactgttgaaccaggcgattctcgcaacggcaataatgctaaaagccgtgctgaatttgatgttgactttggcggtaagacagttgcaggcaagttttttgatgccgacggtattcaaccagccctcacaatggatagtaccatgattacaggtaacgggttctccggcatggctaaaacccaaattgatggctttcagttagataaaggcagtacaactggtggtaccaaagtaagcttcaccgatgctaaagtcgagggcgcattctacggtccgaacgctgaagaaatcggcggtaccatcacatcgaatggcgcaggcgataaagtcggcggggtgttcggcgcgaaacgccaagaaccatcgaaatag

SEQ ID NO: 828 - protein, 654 aa, H. somni
MTSFKLLGFSVLSVALLSACSSGKGGFDLDDVEHTPPSSSGSSRPTYQDVPTGQRQQEIVEEINSPALGYATEIPRRNISPMPTTGTKESNARVAITAQQVAPLSMPFNSIKEDFIKRLIAENTKKNARGRDVKYFDDTDDVLFAHDGSNLAHKRDLQYVRVGYVLGTRKIELVFSHDKKTRDQFPAGWVGYVFYQGTSPAVTLPTQTVTYKGYWDFVSDAFNERTLAEDFTQENSSATSNIPGNQIGATSMDALVNRKVSGEKINIAHSAEFTADFGSKKLSGELKSNGYVSRKENDQDVKTRYKINADIKGNRFVGSATSTANGHTIFGKDADKRLEGGFFGPKAEELAGKFLTNDNSLFVVFGAKRESKGDEKLETRFDAVKISTDSNKLEKETMDTFGNASYLVLDGRQFPLVPESNAGTTGAGNTGKNDFITTIDGNQLSKTNHDKHKNYKVTVCCSNLQYVKFGSYGEQTTATTHNGTSTSQLTNGHLFLTGERTSLADMEKEKGTANYRGTWQANFSSNDGRVSTVEPGDSRNGNNAKSRAEFDVDFGGKTVAGKFFDADGIQPALTMDSTMITGNGFSGMAKTQIDGFQLDKGSTTGGTKVSFTDAKVEGAFYGPNAEEIGGTITSNGAGDKVGGVFGAKRQEPSK

SEQ ID NO: 829 - DNA, 801 bp, H. somnus
atgaaactttctttctcaaaaacattattatcaatggcaattttagttggtttaacagcttgtggatcaggtggtggatctggcagtacagcacctcgtacattgtcaagctcagatgctggtgccgcctatatagcaaaaaccaataatcatggagaaattacatccgtcactcattctataatcaaaaataaaaatgacatttcatttggcgagaactacatttctattaatggtgaaaagtttcctatgcctgcagatgcaattcaagaagctgagcaccaattttatcaaggcttaaacgcaataaaaaatgcaactgatttagatattgaagacatttcaggggtaggaatatacattgtgtatgataaaggtgccgctttctatcttggaaaccctacaaaagacatgccaatttcaggaagtgctacatacctaggaggtgctatgctttttgaaaataaagaatttttggctcctctaaaagaaggaaagacaaaattaattgctgatttttcaaataagaaacttgatggttctttggtattttctgatatatcaccaatcaacatatctgccaatatagatcaaaataactttacgggtagagcaagctcaaattcattatcccctggtcatgttgaaggaaaattctatggtaaaaatgcagcgagtatatctggaatagtgaaaagtgatgatttacaaggcaataaaggttggattgctatattcagtggagcggataaaaaacactttactccgcaaggattaagagatttaggtattcaagaataa

SEQ ID NO: 830 - protein, 266 aa, H. somnus
MKLSFSKTLLSMAILVGLTACGSGGGSGSTAPRTLSSSDAGAAYIAKTNNHGEITSVTHSIIKNKNDISFGENYISINGEKFPMPADAIQEAEHQFYQGLNAIKNATDLDIEDISGVGIYIVYDKGAAFYLGNPTKDMPISGSATYLGGAMLFENKEFLAPLKEGKTKLIADFSNKKLDGSLVFSDISPINISANIDQNNFTGRASSNSLSPGHVEGKFYGKNAASISGIVKSDDLQGNKGWIAIFSGADKKHFTPQGLRDLGIQE

SEQ ID NO: 831 - DNA, 906 bp, H. sputorum
atgtcatctctaaattatcctttcaaatttggtgtaactgtattagctgctctagtgttatctgcatgcggtagcagtggcagtaattctaatagtgcgccacctgtaaataatcaagttcaacaaacgccaccaacgcctaccaagaatcctgaggttcagcctaagccgcaaactgaaatcagtccaaagactacaccaaataatcaatcacaaccacctaaagtcaatatacctgcaaataacgtagttcaagctaatccacaaactggccgtgaaacaggcgcagtattggttgcttcaggtcgtggtgataaggcttctatgcatcgggtagagatgaataattatacccctaaaatgagttcaattaatgttgaaggaactgatgttgacattggtatccgtggacttacagcaaagcattggctcaattttttaaaagaaaaaaagaaaagacgttttgatgtatgttgtggtatctattcagatatgcgttttggttcaaatagtggcttgattgataagagccatatttatttcttctataatggcaacccaactaacgatatgccgacaacaggtacggcatcttatgttggtcatgcgattacttcagtagatcttaatccattagaccatagagatctctatcaaggcgattcgcaatttaatgtggattttgggaataaaacattaaatggcgcattagatattcgaaattttcatgcagacattaatgcaacaattgcgggcaactattttaacggtacagcaaattcatcattagtatcgacaggacgcgtagaaggtaaattttatggttctcaagcaaaagaactggctgggttcgttcaagcaaatgataatagttggggcgcggcatttggcgcaaagcaagaataa

SEQ ID NO: 832 - protein, 301 aa, H. sputorum
MSSLNYPFKFGVTVLAALVLSACGSSGSNSNSAPPVNNQVQQTPPTPTKNPEVQPKPQTEISPKTTPNNQSQPPKVNIPANNVVQANPQTGRETGAVLVASGRGDKASMHRVEMNNYTPKMSSINVEGTDVDIGIRGLTAKHWLNFLKEKKKRRFDVCCGIYSDMRFGSNSGLIDKSHIYFFYNGNPTNDMPTTGTASYVGHAITSVDLNPLDHRDLYQGDSQFNVDFGNKTLNGALDIRNFHADINATIAGNYFNGTANSSLVSTGRVEGKFYGSQAKELAGFVQANDNSWGAAFGAKQE

SEQ ID NO: 833 - DNA, 813 bp, H. sputorum
atgtcttctgtaaatcacgtattcaaatttggtgcaactgcattagcagctttagttttatctgcatgtggcagcagtggtggcggtagtaacaataatgaggctaccccagcgaataatcaaacacaacaaaaccaatctaatccatctgctgctaacaattcagcacagcctaatcagcaagcaagtagcggaacaggagctgcacttgtggcttctgatagtaccagtctttctattcgtcgtgtagaactcaaaggttataataccactagcatcaatgtagatggaactaatgtagcaattggttttccaggaatttcagctggtgattggttaaatgctaaagctaatggacgtgatttaaaagtgtgttgtggtatatattcagatatgcgttttggtcttactgatagcttagatgataatggcaatgcttatgtattctataatggcaatccaacccgtaacatgccaaccagcggaagtgcatcatattctggtcaatctatcatttcagctaatgttccagcattagataaagaaggtttctacaccggcacttcacaatttaatgtggattttggcaacaaaacattaaatggctacttagggatcaataatattcaacctgtgaacattaatgcctctatttcgggtaacagctttaatggtacagctacttcctcatcattaccgtctgctgggcgcgtagagggtaaattctatggtgatcaagcgaaacagcttgctggattagcacaagcgaatgataataattggggtgccgtattcggtgcacaaaaacaataa

SEQ ID NO: 834 - protein, 270 aa, H. sputorum
MSSVNHVFKFGATALAALVLSACGSSGGGSNNNEATPANNQTQQNQSNPSAANNSAQPNQQASSGTGAALVASDSTSLSIRRVELKGYNTTSINVDGTNVAIGFPGISAGDWLNAKANGRDLKVCCGIYSDMRFGLTDSLDDNGNAYVFYNGNPTRNMPTSGSASYSGQSIISANVPALDKEGFYTGTSQFNVDFGNKTLNGYLGINNIQPVNINASISGNSFNGTATSSSLPSAGRVEGKFYGDQAKQLAGLAQANDNNWGAVFGAQKQ

SEQ ID NO: 835 - DNA, 609 bp, H. sputorum
atgaaaaaattacttctttctgcaattttagttggatttttaactgcttgtagtggtggtggcggtggtagtggtagtggaaccgcaacgacacctgataatactaaagtggatttagataacagtgctaaaggcgatattggtgcaaaaaccacggacggcgaattatatggtcaaaatagtaacgattctttctacggcatttggatcaacgatgcgaagacggtgaaagaagtgcgttaccaaggaacagccgcaactaatttaccaagcggcacagcgacttatttaggtgatgcttactgggtaaatggcacaacagggcagccaagtaagggcggtaaaaccagattaaatgtggatttcgacaaaaaaacggtagatggaaaagttgaattttcattgctttcagatggtcgagcacaagatattacgttacaccaaacgcagttaaacggtacaaaatttagcggtcgtgcgagtaccttgttacaagaagggacatatcaaggtggcttatttggcaatggcgcaaaagaagcggctggtattgcaacctttgaaggcaatcacagctatgacacctcatttggcggtattcgttactaa

SEQ ID NO: 836 - protein, 202 aa, H. sputorum
MKKLLLSAILVGFLTACSGGGGGSGSGTATTPDNTKVDLDNSAKGDIGAKTTDGELYGQNSNDSFYGIWINDAKTVKEVRYQGTAATNLPSGTATYLGDAYWVNGTTGQPSKGGKTRLNVDFDKKTVDGKVEFSLLSDGRAQDITLHQTQLNGTKFSGRASTLLQEGTYQGGLFGNGAKEAAGIATFEGNHSYDTSFGGIRY

SEQ ID NO: 837 - DNA, 996 bp, Haemophilus sp. C1
atgaaaccaacctttaaaacaaccgcacttgcgattttagtttcattgggtgcaacggcttgtctttctaattctgataattcgccagcaaaaccaacacccgttcaaccgcaaaattcatcagatgcgccagctattacgcttgcaacacctgaagactataattatgaggaagcatctaaaacgtcaaatggaacgaagtggcgtacattagatttaaataatacagcttcagataataatccatcaggctctaatgaacgttttggaattaatatcgtcgggtctgattctttagtggctggtactttagatttaaacgaaatttcagggaataaattaggttctcatgaagggaaaaaaacaataaacaatacagaagtgacatatgatgtagtcaatttgccatatgctagctatggaatggcaacgactgaggttgatcccgatccaaggaatcgtgcaagagaatccaaagagcatgtaaaatatgtactatattttgggggagcatatttacctcaatctgatggacctggtttgggggggattggcaatggtaagtttgcatatgaaggaaatgttaaggcaatggtaaaagatattcagggtgaggtaattgcttataataaaaatgatggtgtagtaaagctaactatagattctagtaaattcttagcggggcgatcgaaaatacttgatttctctggtgaaatgagtagtaagctattagggcgtacaattcaacttaagactgataaaccagaggactttataacttatcaagattataaggttactggcgatgcaatctataacactgatactgatggacggtttaaattagaattttatggtaagagcggtttttctgatatggcaggtacagccactatttatagcaaccctcgttcaccaaatggtgatttaggtagtattgatggcaaaaaaattagtagttatgaagcagtatttggcggacaaatacaaccataa

SEQ ID NO: 838 - protein, 331 aa, Haemophilus sp. C1
MKPTFKTTALAILVSLGATACLSNSDNSPAKPTPVQPQNSSDAPAITLATPEDYNYEEASKTSNGTKWRTLDLNNTASDNNPSGSNERFGINIVGSDSLVAGTLDLNEISGNKLGSHEGKKTINNTEVTYDVVNLPYASYGMATTEVDPDPRNRARESKEHVKYVLYFGGAYLPQSDGPGLGGIGNGKFAYEGNVKAMVKDIQGEVIAYNKNDGVVKLTIDSSKFLAGRSKILDFSGEMSSKLLGRTIQLKTDKPEDFITYQDYKVTGDAIYNTDTDGRFKLEFYGKSGFSDMAGTATIYSNPRSPNGDLGSIDGKKISSYEAVFGGQIQP

SEQ ID NO: 839 - DNA, 789 bp, Haemophilus sp. FF7
atgaaaaaatccattttaaccaccgcactttgcctatcttgcgcaataacactcagcgccaatgccgacattagctccggcatatccaataacaatgccgcgttgagcgtaaaaaacccttctgctaaacacgacggctggttccattccgatcccggcggattaccgggtatcgaagtgcaaggcgtaacctctaaagtcaccagttttcaatcgctgaccaaggttgctaataacgtgctggtgccgaaatcactgggtgggcaggataaaaacggtgttgtggtattaaacatgaacaacatgccaagttgggtgccgggcttccacggcaaattaggcaactttgcgtttaaaaaagtcggcacgcaggaattatactacggtgaatggctgggcaacggcgccaacgccaagcaggatcgggtggtatattatgccggtaacaaccaaacacaaaacatgccgaccggcggaaaagccgtgtatagcgtgcagggcattaatcagcacggcaagctgggggctgaaatgctgaaaggcgaactgaccgccgatttcggcaaaaaacaagttaacggctcaatgagcaaaaccggcttaacggtgagcatcaatgatgcgaagattaacggcaatactttctcaggcgccgcagctgcaaataaaaccgtagcaggtaccacacaaggtcatttcttcggcaataatgcggcggcattagccggttatgcgaaattcgccggacataaccaatacgacaccgcattcggcggaacgaaaaaataa

SEQ ID NO: 840 - protein, 262 aa, Haemophilus sp. FF7
MKKSILTTALCLSCAITLSANADISSGISNNNAALSVKNPSAKHDGWFHSDPGGLPGIEVQGVTSKVTSFQSLTKVANNVLVPKSLGGQDKNGVVVLNMNNMPSWVPGFHGKLGNFAFKKVGTQELYYGEWLGNGANAKQDRVVYYAGNNQTQNMPTGGKAVYSVQGINQHGKLGAEMLKGELTADFGKKQVNGSMSKTGLTVSINDAKINGNTFSGAAAANKTVAGTTQGHFFGNNAAALAGYAKFAGHNQYDTAFGGTKK

SEQ ID NO: 841 - DNA, 1338 bp, Haemophilus sp. oral taxon 851
atgaaaccaacgttaaaaacaaccgcattagcgatgtgtattgcactaagtttgactgcttgtaaatctacttcaaattctggagatgctcgtccaacaccagttcaaccagcagcaactcaaccagcagaagaaaaacacaatgaaccacaagcagcaccaggtgtaagcactccggttgctgaccaaggtacttcatctactggttcacaaccacaaccaggagcagattcaaatggacacaatgcagatgtatcaccagcgcctggcactgcggaaagccatactgtagaaactcatcctgagggcgaaacaggcagccacaccgatacagctcaccaagacgagccgcattctaacgaaacagtagttcaaccgaaaccacctatttcaagtgaaccagcacgttcagaagatacacatgctgcggaaaatacaggtgcaaccactggtaaagaagaaaaaccagcaggcactgcagaaactcagcctgtttctccagctccagcagaagaccatactgaatcaccagcagtgactccgtcacaaccatcaacaggtactgatgcaggtacacaaccaagtgcaccagtaaattctggtagttcttctgaatcttctgtacccgcacacagtgaaccatctgcaccagcagataacatgcatactgaggcaggcgcatcgccaacagtaggtgcaggtgagcaccatgatgaaaccaaccatgcaactgagcaaccgcaaggcacaccagctcagccaccggttgcaccagaacgtcatgatgaagcaacccataacacagaaggaaacccatcagtgagtggaacaactgaaactcaaccagcggcatcttcatacgatgatcttaaaaagctgtatcgagatgtagtagatggtaaatctagcgatttagttgatgcaatttataaaggtaaagtatttgcaaaagttaagcttagtaacactgacgaggaaagatacgcacaaacgacgacagatgaagacggtgatgttacacttaatgttcaaaaaaattcttctgataaatttaaaatgtcgggaactatcaatagtaaaaccgtaggtagcattcagttgggagaaaaagagattatagaaaataaagtgaaagatggtcatgtagattttggggatgatgctgacggtaagtattctgctactatttcagaaaatggtgatatagttggacgtgtggagtataattctagacgcgcaatagaggatggtttttatccaagctttgaaggcaaagatggaacaaaatatctttttggctatgaagccttttttgatgcaaccaaacaacctaaataa

SEQ ID NO: 842 - protein, 445 aa, Haemophilus sp. oral taxon 851
MKPTLKTTALAMCIALSLTACKSTSNSGDARPTPVQPAATQPAEEKHNEPQAAPGVSTPVADQGTSSTGSQPQPGADSNGHNADVSPAPGTAESHTVETHPEGETGSHTDTAHQDEPHSNETVVQPKPPISSEPARSEDTHAAENTGATTGKEEKPAGTAETQPVSPAPAEDHTESPAVTPSQPSTGTDAGTQPSAPVNSGSSSESSVPAHSEPSAPADNMHTEAGASPTVGAGEHHDETNHATEQPQGTPAQPPVAPERHDEATHNTEGNPSVSGTTETQPAASSYDDLKKLYRDVVDGKSSDLVDAIYKGKVFAKVKLSNTDEERYAQTTTDEDGDVTLNVQKNSSDKFKMSGTINSKTVGSIQLGEKEIIENKVKDGHVDFGDDADGKYSATISENGDIVGRVEYNSRRAIEDGFYPSFEGKDGTKYLFGYEAFFDATKQPK

SEQ ID NO: 843 - DNA, 822 bp, K. denitrificans
atgaaaaaatatcacgcactgtatatcgccgtggcggctttggcattgggcggatgcggaagcgcaggcggctctttggccaatgcgattaccgacccgttcacaccgaaaccgcacggcaaaagcagccttaccatcaaccaagaccctaataacggcattctgaatgtcggtcacaccgtggcggacaccgtggaaattaacggtctcccctacggcaacaacagcacgctcgacatcgggcataatttccaaaaccgcctgtccgattttacctatgtgttgaaacaaagcgggcgcaatgtggaaagcgggcagctgggcgtgtacaaacgcgcttattcggccgtggtcggcgcaaccgtgcaagatcgctacaaccccaacaccggcgcgcacgcttcctctcccaatcccaatttcactatccgcagcattcagggcgacttaacccccgaatcccgactgcccaccagcggatctatccgttaccaaggacacgccttttccggcttggacgaccgcggcccgaacggccatctgaacagccgcctggattacacagtggactttggcaaccgcaccggttcaggttcgattaccggtttgagccgcttcggcaatatcgaattggcgaccggccggcttgaccgcagcagaagcgcgctggagggcaccgccatctcccaacaacgcggacgcggccattacgaactgaacattttcggcccgaatgcggacgaaattgccggcaaagccaccggattcacgggcgaccacgaagtcggtttttccggcagcaaaacgcagcagaatccgtaa

SEQ ID NO: 844 - protein, 273 aa, K. denitrificans
MKKYHALYIAVAALALGGCGSAGGSLANAITDPFTPKPHGKSSLTINQDPNNGILNVGHTVADTVEINGLPYGNNSTLDIGHNFQNRLSDFTYVLKQSGRNVESGQLGVYKRAYSAVVGATVQDRYNPNTGAHASSPNPNFTIRSIQGDLTPESRLPTSGSIRYQGHAFSGLDDRGPNGHLNSRLDYTVDFGNRTGSGSITGLSRFGNIELATGRLDRSRSALEGTAISQQRGRGHYELNIFGPNADEIAGKATGFTGDHEVGFSGSKTQQNP

SEQ ID NO: 845 - DNA, 2403 bp, K. denitrificans
atgaacaccggaaacttcactttaaaagccttggccattgcgtgcagcctggcactgaccgcttgcggcggcggtggcggcggcggacaaccgagcacccagtcccgcccgaccgtgccgtccacaccaagcgccgccaaaactgccgcagataacgccattgccgatatcgccgccaaagcacaagccgtgcaggctgctttgacgcgcaaccacgataccgacaatgacggcaaaatctctgccacagaagccgccgcggccaaccaagccatcaacaatgccaaagccgcattgcaggctgccattgccaatgcagaaaccaaagcccaagatgccgccttgtcgcctgccgaaaaaacgcaggccaccgccgcattgaccaccgcgaaaaacagcgcaaatgtccgtaacgcgcaggctgcttccgccaacgtgcaacccactccggcacccgcaccgcaaccgcctgccccacaacaaccgagtgccgccaaaactgccgcagataacgccattgccgatatcgccaccaaagcccaagccgtgcaggctgctttgacacgcaaccacgataccgacaatgacggcaaaatctccgccacagaagccgccgcggccaaccaagccatcaacaatgccaaagccgcattgcaggctgccatcgctgatgcagaaaccaaagcccaagatgccgccttgtcgccagccgagaaaacacaggccgccgctgcattgaacgccgcgaaaaacagcgcaaatatccgtaacgcgcaggctgcttctgccaacgtgcagcccactccggcgcctgcaccgcaaccacagccgcaaccgccccaaccaagcgcagccacaggcttcggccaagacaacaacggccgcatgaaacccaatgccggcggcgtttccggcggcgtgctcagtaccgatgctatgcgccaatccgatgaaagctcatacggcagcattcaaaaccccgaaggccgcagcaaaaacgaagtggtgctgaacggcgtgaaaatcgccaccgccaccaccggccaaaaacgctacgaaaccgaagagtccaataaccaaaccgcaaaatccatccacagtagcgacattctgcccgacgtgcgctatggcgcggtggtcgatacttcttccggcgtgatggccatccgccaaggcctgttcgtgcaaggcacggcagcaggcgcggacacagtggccgtgaaaaccggcacggtggaatacaacggtaccggcctgcatttcggcaaaccgagcagcgacgccactgccggcctgccgttcatgaccgccgacccgtcatggggtgtgaatgcgcccaacacggaggatttgtacaccagcggccgcgccactaaagtgaaagccagcgtgaacttcgacaataaaaccatcggtatcgacatcagcgatccgggcagccgtacccaaggtcgtccgaatgcgtccgaactggccggcgcgcccattcattttgacggcgtgattcaaggcaattcgttcaccaatgcggcaggacaagagaaaacctttgccggcggcttctatggtgcggcggccgaccagttggccggtatgtaccgcctgaatgcgcaaaaagccaacgaatcgagcggtgtattcggtgcgcaggcaagcacaggcagcaatacccccgcccctgcacccactccttcacctgcgccaaccccaacgccgactccgccaagcagcggcgcagtaaccgaatcgacttattataaactgcctgagcagcagcaactgaccgatgcgaaactgccgatggccgaaaccaaccaagccatcagcaaaggcatccaaactttggtggtggacggcatttctatcgccctgcccgccgccaaccaaggcttcgagaaaggcatgaattattatgcattcaacaatgcgggcaatgtgattgcgggtgcggcgcagattatgtcgggtggcaaagaccaaggcctgctgttcgtgcagggcaacctgacgccgcaagaccaaatcccgaccggcacggccaattacagcggcaaagtgttgcacttccgcgagcgcgtggtgcggcatgaaaacggcaatttggtgaatgtcgatccgggctatgtatttactcaaggcagcttcaccgcgaaagccgattttgccaaccgcaacctgtcggtaacgattaattcgggcgactacaactatatgcgcacgaaagtgttcaccgccaacatcaacggtaatacgttctccggcaccggatccgaccgcagcattgaaggcggcttctatggcgcgaatgcagccgcgattgccggcaaataccaatattcggacggcagcaccagcaaatggagcgacagcggcttcggcgtgttcagcggcaacaagcaataa

SEQ ID NO: 846 - protein, 800 aa, K. denitrificans
MNTGNFTLKALAIACSLALTACGGGGGGGQPSTQSRPTVPSTPSAAKTAADNAIADIAAKAQAVQAALTRNHDTDNDGKISATEAAAANQAINNAKAALQAAIANAETKAQDAALSPAEKTQATAALTTAKNSANVRNAQAASANVQPTPAPAPQPPAPQQPSAAKTAADNAIADIATKAQAVQAALTRNHDTDNDGKISATEAAAANQAINNAKAALQAAIADAETKAQDAALSPAEKTQAAAALNAAKNSANIRNAQAASANVQPTPAPAPQPQPQPPQPSAATGFGQDNNGRMKPNAGGVSGGVLSTDAMRQSDESSYGSIQNPEGRSKNEVVLNGVKIATATTGQKRYETEESNNQTAKSIHSSDILPDVRYGAVVDTSSGVMAIRQGLFVQGTAAGADTVAVKTGTVEYNGTGLHFGKPSSDATAGLPFMTADPSWGVNAPNTEDLYTSGRATKVKASVNFDNKTIGIDISDPGSRTQGRPNASELAGAPIHFDGVIQGNSFTNAAGQEKTFAGGFYGAAADQLAGMYRLNAQKANESSGVFGAQASTGSNTPAPAPTPSPAPTPTPTPPSSGAVTESTYYKLPEQQQLTDAKLPMAETNQAISKGIQTLVVDGISIALPAANQGFEKGMNYYAFNNAGNVIAGAAQIMSGGKDQGLLFVQGNLTPQDQIPTGTANYSGKVLHFRERVVRHENGNLVNVDPGYVFTQGSFTAKADFANRNLSVTINSGDYNYMRTKVFTANINGNTFSGTGSDRSIEGGFYGANAAAIAGKYQYSDGSTSKWSDSGFGVFSGNKQ

SEQ ID NO: 847 - DNA, 960 bp, K. denitrificans
atgaagcatttgttcagcacaaccattatcgccctcagcctggccgcttgcggaagcagtggcagcagcgccccttccacacaaagcaacacaccccaatctaccgcatcacccgatgccgagtcttccgccgttaaaaaccgctccagcttggactaccgccgcaattatgccggagtggtcagcagcaaaagtgtgattgccgcacaaaccctgttgggaccgcaggccggcagcaacacgcgcggtgagaaaaacctcacccttacccttaacggccgcagttacggactggccgaccgcatcaacattaccgcgctgccggacggcctgctcgaactgccctacaaagccgaatggacgtctttgaaagtcgcctaccccgacagccgagatgtaaaagtggaagaacaagggaaaatgtatatctaccaacgcccctactccatggtgttggccaccctgcccaccgcctaccgttacgatggtgctaacgacccgaacaaccgactcggtcgcgctgacaccatgaaggtgcagctggtgagcggcctgcccgtgaacgatgccaccatcacccgtctcagcggcaacacgttcaactacagtggcgaatcttttgccaatttcggttctggtttggaaaaaggcgcatttaactacagcatcaactttaccgataaaaccggtagcggccgcattaccggcatggcttccaccggcgatatcgaactgcgccaagcccgtatcggcggcgcactgccatacaatccgatgctgtcggctgccgaacgcaccaaaggcatcaacggtgaagcccattccgaacgcatgaatgcctaccgatattacctttctattttcggccccaatgctgaagaagtagccggttttgtggaaggcagccgcagcaatcctggcggccaatggaatatcggcgtcagcggaaccaaacagtaa

SEQ ID NO: 848 - protein, 319 aa, K. denitrificans
MKHLFSTTIIALSLAACGSSGSSAPSTQSNTPQSTASPDAESSAVKNRSSLDYRRNYAGVVSSKSVIAAQTLLGPQAGSNTRGEKNLTLTLNGRSYGLADRINITALPDGLLELPYKAEWTSLKVAYPDSRDVKVEEQGKMYIYQRPYSMVLATLPTAYRYDGANDPNNRLGRADTMKVQLVSGLPVNDATITRLSGNTFNYSGESFANFGSGLEKGAFNYSINFTDKTGSGRITGMASTGDIELRQARIGGALPYNPMLSAAERTKGINGEAHSERMNAYRYYLSIFGPNAEEVAGFVEGSRSNPGGQWNIGVSGTKQ

SEQ ID NO: 849 - DNA, 1023 bp, K. denitrificans , HpuA
atgaaccttccatcatccgcattatcgttgctcgcgctggccacattggccgcctgcgccggcggcagtgccatcaacgaaccgctgaccgccgcaccgattcccgttttgagggctgtcgatacgacatcgcccaatattgtggcagacaccagcaccgaccgcgaacagcgcacgttcgccacgcagggtggctcggtcaaaccgttcactatcaccaagcccagcccctatattcctggcctgatgctgaccaatcaggaaatcctgtatcaggcaccggacggcaaatattacgatttcggcacatacaacacgctgattatgccctcttccagcacttcggcgcgcgtcctgcccaacagccaccccatgcagccgttggacagcggcggcaaaatgattgcctgctgcaccaaccaaacgtccaccggcatgaatgcgctgcgcttgaaaagcatgcaattcggcgcatggatgtcgcccagcaaaaccgtcagcctttttgccggcggcacacctgcaccgacagacacactgcaaggcgtcgataccgccggccgccccaccggcaaggcaacgtatgaagtcatcggcctgcgcgtgaaaaacgaccgcgccgtcacttccagctacgaaacgcgttattcgccgtacaacaccggacaagtcgttaccggctcgttcttaacggtgaacttcaacaccggcaaactgggcggtacgattgtcggcaattcggagttcggcgattcgattgaaatgcgcgatgtgaacgtgaacggcaaccagttcagcggcactgccagctccggcgggcataccggccaagtcagcggcggattgttcgccaaagaagaacgcttttacagcggcacgttggagcatccttccggcggcgaaatcggcggcacggtgaacttcggcagcaacagcccgctgaatgcgtcttttggcggcacgcggcgcgaatataacgcggcagacaccagcacggatacctcgcatttggtcagcccgtaa

SEQ ID NO: 850 - protein, 340 aa, K. denitrificans , HpuA
MNLPSSALSLLALATLAACAGGSAINEPLTAAPIPVLRAVDTTSPNIVADTSTDREQRTFATQGGSVKPFTITKPSPYIPGLMLTNQEILYQAPDGKYYDFGTYNTLIMPSSSTSARVLPNSHPMQPLDSGGKMIACCTNQTSTGMNALRLKSMQFGAWMSPSKTVSLFAGGTPAPTDTLQGVDTAGRPTGKATYEVIGLRVKNDRAVTSSYETRYSPYNTGQVVTGSFLTVNFNTGKLGGTIVGNSEFGDSIEMRDVNVNGNQFSGTASSGGHTGQVSGGLFAKEERFYSGTLEHPSGGEIGGTVNFGSNSPLNASFGGTRREYNAADTSTDTSHLVSP

SEQ ID NO: 851 - DNA, 555 bp, K. kingae
gtggatggtgtcagcattcagttgccaaacaaaacagacagaacaactttaacagaagctgacaattaccgtattttcaataacctagacaatgtggtttatggtgcagcaactggcaacggtaaacacgctttgtttgtacaaggtaatttaactgccgatatgcctagtggcacagcaaaatacagcggacaagtgttgcactatcgtggtcgcgttttgaatggctctggtgtattgactggctctaatatcgactacacttacacttacaacggcacattcaccgcaacggctgatttttcaagcaaaaaactgtctgctatcattaacagcggagatagttcgtatatgggaacaaaaaccttcaatgcggttattaatggcaacagatttaagtcagatagctcatcgcccgatcaaacgatagaaggtggtttctatggtgctaatgcggcagaaattgcaggtaagtaccaatttattgatggtaagagtgatacactttctgacagtggcttcggcgtattcggcggtaaaaaacaaacgccctaa

SEQ ID NO: 852 - protein, 184 aa, K. kingae
MDGVSIQLPNKTDRTTLTEADNYRIFNNLDNVVYGAATGNGKHALFVQGNLTADMPSGTAKYSGQVLHYRGRVLNGSGVLTGSNIDYTYTYNGTFTATADFSSKKLSAIINSGDSSYMGTKTFNAVINGNRFKSDSSSPDQTIEGGFYGANAAEIAGKYQFIDGKSDTLSDSGFGVFGGKKQTP

SEQ ID NO: 853 - DNA, 1062 bp, K. kingae
atgaaacaacctattacttttaaacccttgattttagcaactttatgtgcttcggttttatcggcttgcggtggcggtggaggcggttcaaatgtaaatacaaatggcaccaatactgttccaactaaaccagcacaacctaataaaccagtgcagcctaataaaccagtgcagcctaataaaccagtgcagcctaataaaccagtgcagcctaataaaccagtgcagcctaataaaccagtgcagcctaataacccagtgcagccaccattaaccaagcagcaattgactgacaaaaaagccattgcagaaaaatctggttttggtgtagtacgaaacaatgtagctaacaccattcaaaccgccgaagttaaaatcggcaatcatgtttacaaaggcaaagctgacgatgccagcaaaacgtattatgttccgttaaacatcaacgattttaaacagggtatgagcgaaggcaatttaagcagcacatttaaatatgcagatggctctactgtccaaaccgatagcacttataaagtgtataaccagccgttttcgtttgtggcaggcatctacgataaccatgccaaaattcaaagcccaacggaaaacaataacgacaaataccgcattgtatatggtggaatttcgcccaaggttttgcctgaaaacaacacgttccactattcaggtgttgcctacaacaaaggcgaaacaggcaaattgaattataatattacctataccgccaacaacaacggcaggggcgaaggcgacatcacagggctaaaccaagtgggcgatattgagctgagatggagcgatattcatactactaatgggcatcagcatcctgatttaaaaacaggcaattcaggaatattacctagttttggtattgcaggactggctgtacgcaagaaaacaggcgacgaaatagggccctacgaattgggtatttatggcacagatgccagcgaaatcgcaggcaggattaagagcaaacatgatctagataatgtgatgtttattggcaaaaaacaatctgcgcctaatccgtaa

SEQ ID NO: 854 - protein, 353 aa, K. kingae
MKQPITFKPLILATLCASVLSACGGGGGGSNVNTNGTNTVPTKPAQPNKPVQPNKPVQPNKPVQPNKPVQPNKPVQPNKPVQPNNPVQPPLTKQQLTDKKAIAEKSGFGVVRNNVANTIQTAEVKIGNHVYKGKADDASKTYYVPLNINDFKQGMSEGNLSSTFKYADGSTVQTDSTYKVYNQPFSFVAGIYDNHAKIQSPTENNNDKYRIVYGGISPKVLPENNTFHYSGVAYNKGETGKLNYNITYTANNNGRGEGDITGLNQVGDIELRWSDIHTTNGHQHPDLKTGNSGILPSFGIAGLAVRKKTGDEIGPYELGIYGTDASEIAGRIKSKHDLDNVMFIGKKQSAPNP

SEQ ID NO: 855 - DNA, 1011 bp, K. kingae
atgtatacaaataaaagcaaaactttattggcacttttgattgcaaccgcattatctgcgtgcagcggtagtggtggcggttctggtttatccgcagcaggaacaggaagcaatggtttgaattcgggtagcacttctactacacctaacaatacaggcaacaacggtggctctacaactgacaatacaggcacaaatacgaatactactaccggatattctcctgtactagatgcagcagctattaaagatgcctataccaaaattgctgataagaacaaggcaatagtaaccgatcccactactagcgcagtagaaagtttaacagtttccattaccaaaggtactcaaaccgatacacatttaactgtgagtgacattaatcttaacaaatatctgccacataatgaactcacagatttaaccatgcagactaaacataccttaacgtataacgtaagccaaccagaccaaaagcaataccgttatgaaacaactgaaaatgtgcgtgcttataaccaaaactactcgactgtgataggctttgatacaactggtatcaaaaccacaatgattggttacgatacaaagaaatctgaagaaaaaacttaccctgacaaactaatgaatagctatgctgttacaggtgtatctattgaacaagctgcactgccagctactggttcttatacctatacaggtaaagcattcactgccacagataatgacggtgtgttgaactacaccattaattttgataaaaaatcgggcagcggttctattactggtattgataaaactggtacgattactttgggagaaggtcgaatcggcacttacactcatggcaccaagacaagtactgcgggtattggtgaaacacaagcaaccactgccaatggcactgctggtacttacacattaggtatctttggtgctaatgcagaagaagtagctggtacagtaaacttcaagggcttagagcacgttggtttcggtggtaaacgctaa

SEQ ID NO: 856 - protein, 336 aa, K. kingae
MYTNKSKTLLALLIATALSACSGSGGGSGLSAAGTGSNGLNSGSTSTTPNNTGNNGGSTTDNTGTNTNTTTGYSPVLDAAAIKDAYTKIADKNKAIVTDPTTSAVESLTVSITKGTQTDTHLTVSDINLNKYLPHNELTDLTMQTKHTLTYNVSQPDQKQYRYETTENVRAYNQNYSTVIGFDTTGIKTTMIGYDTKKSEEKTYPDKLMNSYAVTGVSIEQAALPATGSYTYTGKAFTATDNDGVLNYTINFDKKSGSGSITGIDKTGTITLGEGRIGTYTHGTKTSTAGIGETQATTANGTAGTYTLGIFGANAEEVAGTVNFKGLEHVGFGGKR

SEQ ID NO: 857 - DNA, 885 bp, K. oralis
atgaaaatgaaattaaccgtattggcgtgtgctgcattgtttggtttgactgcgtgtagcagcggtggtaattcaggcgtaagttatggtggcacgattggtgggggggcaagtgcaagacctacgcctcctgcacccaacccaaatccagcacctaatccaaaaccagcacccaaccccgcgcctactccaaatcctaacccagctccaaatccagcacctgcccctgcccctgctccatcagcaacattcaatggtgttgctattccagcagaaagccaaaatggtgctaatacacccgttagcgcagttggtagcagcacactagacaatgttactgtaaacggtattaacatcactttaaaacaacctggtattactgctcgtacatttaccaatatcagaaaaaacacagaaaccaccattgctagtggtacatatttgagccatatgcgttttggtgcatatgctgatttcaaccacaacaacaatcccgattcaaacccatcttatacgtttgcattgggtagtgtaacgcctgttgccgatgttcccacatcaggcacagctacttacaatggtttggcagtaggtagcgtaattggtggtggtgcattccaagaaggtacatcaacatttaatgtggattttggcgcgaaaaaactagatggttcagttactattggcgctttcaatcctattcctttaactgctaatatcaacggcaaccaattctctggtacatcagcagagggagttcataccgatggtcgcttctatggtccacaagcagctgaaatgggcggagtattcaatggagaagttcctgcaccagttggtggcggtactttcaaatggattggttcatttggcgcgaaaaaataa

SEQ ID NO: 858 - protein, 294 aa, K. oralis
MKMKLTVLACAALFGLTACSSGGNSGVSYGGTIGGGASARPTPPAPNPNPAPNPKPAPNPAPTPNPNPAPNPAPAPAPAPSATFNGVAIPAESQNGANTPVSAVGSSTLDNVTVNGINITLKQPGITARTFTNIRKNTETTIASGTYLSHMRFGAYADFNHNNNPDSNPSYTFALGSVTPVADVPTSGTATYNGLAVGSVIGGGAFQEGTSTFNVDFGAKKLDGSVTIGAFNPIPLTANINGNQFSGTSAEGVHTDGRFYGPQAAEMGGVFNGEVPAPVGGGTFKWIGSFGAKK

SEQ ID NO: 859 - DNA, 900 bp, K. oralis
atgatgtctttaaaacaactcggttcgctcactttggtcgcactttgcttggcggcgtgcagcagcggcgggggaggcagctcgggcaatctcaacgctcccgacacgggcaacaataacaacgccaataataagcatacggataaaagcgtgtccaaactgatttcggttgccgagttgagagacaaggcagagattgatttgcaggatgagtttggtgcttccgccaaactgtcttcatacgcgattaagctgaacgggaaaacctacacccgtggcaacattgatttggctacgctgggcaacggcttcaaacgtgttgatgttaccgaaaccgcatccgccaaaatcaacgggcaaacccacaacgtaacccaaaacagcaaattgcatctgtatcagcaaccttattctgttgtggcttccatgcaaaccatggatgggcaggttggcaatttgggcaaaattgaaaaaggcgaatttgaagtttctttgtttgatggtcagccaactaaaacgcttcccagcgcaggctcgtttaactacaaaggcgttgcctttaccgaaaaagaacaaggaaatttgaattacaccatcaactttgacactaaaaaaggcgcaggttccattagcggcatcaatcaaacaggcaacattacgctgcatgaaagcgatattgtgaaagttcaagatggtgtggcatttaaaaataattccgcctttacttatggtgagaaaaaagatgtctatggtgtgctcaatggcgcagcaaccactgaaaaacaaggcgtggcaagttatgaattgggtatttttggaccgaatgccgatgaagtggccggggcggttttccaagaacacgatgaagggacggtcggctttggcggcaaaaaacaataa

SEQ ID NO: 860 - protein, 299 aa, K. oralis
MMSLKQLGSLTLVALCLAACSSGGGGSSGNLNAPDTGNNNNANNKHTDKSVSKLISVAELRDKAEIDLQDEFGASAKLSSYAIKLNGKTYTRGNIDLATLGNGFKRVDVTETASAKINGQTHNVTQNSKLHLYQQPYSVVASMQTMDGQVGNLGKIEKGEFEVSLFDGQPTKTLPSAGSFNYKGVAFTEKEQGNLNYTINFDTKKGAGSISGINQTGNITLHESDIVKVQDGVAFKNNSAFTYGEKKDVYGVLNGAATTEKQGVASYELGIFGPNADEVAGAVFQEHDEGTVGFGGKKQ

SEQ ID NO: 861 - DNA, 1023 bp, Kingella sp. Sch538
atgagtaaaaatatagttttattggcaatggcgatggctacagcattatctgcgtgtggttctagcggtgggggttcagctttgagcgcgacaaacactacgtcttctaatttgggtgtgaaaaccaataacaataattcttctaaaacagaaacaacaaacgaaaacacgactaataccacaaaggtaacgttttcacctgtgttagatgtggcagctattaaaacaagtatgaaagaagctgccgacgctgcagcaaaagcagagttatatagagtacctaaaactatcgtttcttctgcagaaagtttaactattgatttaattgataccaaaaatcaaaccaaaacttatttaacagatagtaatattgagctgaaagattatctaccgaagaatgaagtaacagatgtaacgatgaaaatcaaacatacattaacttataacggttatgataaagaagataaggaagttcaagattcttaccgtcgagacctcactcaaactgtacgtgcttataatcaagattactctactgtgattggttatgatacgaccaacgatgattttgctacatttaatagtagtaaagatactagtgtaaaaaaagttaataaaacaagctattctgataaattgatggatacttatgatgtggttggttcatctattaaaacagctgcattgccaactagtggctcttatacctattcaggtaaagcattcacagccactgacaaagatggtgtgttgagctatacagtagactttgataaaaaatcaggtaaaggttctattacaggtatcgacacaactggcacgattactttggaagaaggcaaaatcggttcttatacacacaaaaccacaacttcttctggtatcggtgaaactcaagcaactacagctaagggtattgtaggcacttacaccgtaggtttcttcggtccaaatgctgaagaagtggctggtactgccaactttaaaggtttggaacacgttggttttggcggcaaacgctaa

SEQ ID NO: 862 - protein, 340 aa, Kingella sp. Sch538
MSKNIVLLAMAMATALSACGSSGGGSALSATNTTSSNLGVKTNNNNSSKTETTNENTTNTTKVTFSPVLDVAAIKTSMKEAADAAAKAELYRVPKTIVSSAESLTIDLIDTKNQTKTYLTDSNIELKDYLPKNEVTDVTMKIKHTLTYNGYDKEDKEVQDSYRRDLTQTVRAYNQDYSTVIGYDTTNDDFATFNSSKDTSVKKVNKTSYSDKLMDTYDVVGSSIKTAALPTSGSYTYSGKAFTATDKDGVLSYTVDFDKKSGKGSITGIDTTGTITLEEGKIGSYTHKTTTSSGIGETQATTAKGIVGTYTVGFFGPNAEEVAGTANFKGLEHVGFGGKR

SEQ ID NO: 863 - DNA, 768 bp, L. adecarboxylata
atggggatcttaaaacctggtttattactgactgcttttgtgctgactgcatgtggaggcggtggcggtggtggcggcggcggtggaagtgacagtacgcccccggtaaccactgcgcctgtgcaaacggataacggcaacacggacaccacaccggaaacccctgtcacggcaccggaaacccctgctacggcaccggtcagcctgaccaccggcggtaccatttcgggttggacctacaccacacctgagggccgtgaatacgttatgcgcggcaccgggatctctgctggtctggtgcaaacccagcgactcacccgtgacgaccattccccggtctcctcaacgtcatggtgctgtggccgtatgagttacaccaccttcggtacctggacacagtatgaaaaaggtcagcatgacgtcttctacaccggggatgccacgctcgcggctaacgtgccaacccagggaacggcgacctatgtgggtcacggcatgcgtgaaaataatctgagtgatgctcgctttgacattgatttcgcggcgaaaaccatcaacggcacccttgccggaaatgataccttcggtagcgaagttgcgatgcagggcaacattgccaacggtggtttcaccggtaatgcgcaatctggcggacaggaagggacgttcaccggacatttcaatggtcccacagctgaagagttaggcggtctggcgcagtttgcagacacgactaaaaacgcttcctttggcgcgacacgtcaataa

SEQ ID NO: 864 - protein, 255 aa, L. adecarboxylata
MGILKPGLLLTAFVLTACGGGGGGGGGGGSDSTPPVTTAPVQTDNGNTDTTPETPVTAPETPATAPVSLTTGGTISGWTYTTPEGREYVMRGTGISAGLVQTQRLTRDDHSPVSSTSWCCGRMSYTTFGTWTQYEKGQHDVFYTGDATLAANVPTQGTATYVGHGMRENNLSDARFDIDFAAKTINGTLAGNDTFGSEVAMQGNIANGGFTGNAQSGGQEGTFTGHFNGPTAEELGGLAQFADTTKNASFGATRQ

SEQ ID NO: 865 - DNA, 2841 bp, M. caprae
atgcctaagagtaccaaatttagcctattgcctttggcggtggctgtgacttcattgatgctatcagcctgtggtggtggcagttttgataacccaagtaccattgtcatcggtcagtctaggatgattgagaagtctgaccaatcaaagaatgtctcaaccgataaggctgatgacaatgccaatgccaatgctgatactaagaataaagcagacagtcgcctaaccatgccagtgttgggcagtgttttggcgattccaaagcgtaatctggctcttgataagaaaaaactgactcgtctagaagagcatgtgccacttgatgaaaataacatcaagaccgctcatgccaaccctttgccagctttaaccaaagagttacaagagcgctataaggatgaaaagatacatcagagcgatgataaatataagtttgtaaaagctggttggatttttgctggtttgcgtccttatgagacgattacaactgatgaggatacagaccaacctaagcgatataccaaaggcgatggctatctgtactattatggtgaaaatccaaccacagggcttgccaaaggtgtggcaaactatacggggcattgggatttcgtgactgatgtcaagcgaataagagagtctcccaccaaagagaatacaggtcgccaagcgttcggtggtggtttagcctataggatggacagcggctttggtgatgaagtcggtgcgaccagctttgccgagcaagtctttggtcaggtaagcccaagacagggcaatcatcgtgcggtctttaaagctgattttgacgcaaaaaaactgacaggcacactatctaccaagcaaaaagcgattgccagcagtccagagacctatttggaccgctatgatattgatgcgaccatcaagggcaatcgatttgtgggttctgccatcgcaaaaaataccgaaaccagctttatgaagcctaacttttttagtaaaaatgccgatgaccgcctagaaggtgggttttatggtgaaaacgctgaggaattggcaggtaagtttttaaccaatgataattctgtctttgcagtgtttgctggtaagcaggacaaccctgagaaagttgagaagcttgagcaggtatttggtggtgcttatgtcgagctgacccaagacaaggctgtcaaccctgcacaaaagtcacaagtgttatcgctggtgaactttggtaatgtcgaccaactgcaattaggtgatcataccatcacactcctaccccaagaggcaggaaaaacaacgcaacaatctgttaaactgccaacaggacaaacagctgtcatcaccagttttggcagcagtgatggcgttctaagattgggttcggtcagtaagactgccaagaccatcgagacgacggcaaaaagcaaacccgctgaaaatgttaaagtgacgaataaagacaaggttggcgagcctgccaaaccaaccgcagaacaacttgaagctgctaaagaaaaactgactgaaaaaatggatgagctaaaagcagagctgactattctgcttgattcttaccaaaaaaatagtcaagatagagcgaccttaagaaagcaaattactgaaaaggttttattaggctataacgatgagagtagtaagaaaaatgtagcagaagtcctgcaggatatgtttaatagcttggtggactcagatgaggaagaaagagaatgggctgctgataatattctagaaatgcttgtcacaggcgataaatttaacagtgataacttagaaaatttaaaagagttcttggttcagaactcgttggcacaatccgtaccgagccacactcaagatcaaattgctaaggcaaaagccgacttaaaagtaaagcttgaaactgaaaaacaagagctaaaagatctcctggacatcttcgcaatagaaaacggcaacttcaactttggtaacaatgaagagtctaatgaaactgcacaaaatcctgcagaagatgacgatgagcgtgtaaatggtgcgacagatagtgcagatgaagtggcgagtgcggatgttgatgatttggaagaactaaaagcagaagtcatcgataagattaaaactgcctataccaaagacaggcaagatgttattggcaaacaagctgttaccttgcttgaagagttgaaaaatggtaacgaggaagcaagtggcaagttggtagctctgtttgctcaaggtgataaatttaacagtgataacttagaaaatttaaccgcttatctacctgccctgcctagtacgccggatgccagcacgccagagcaatcagatgcaatcccattgattggcattgaggattctttgacaggtttatacatactgggtcagcgtacgccagccagtcagatagccaatcaaggtcaagccagctatcaaggtacttggcatggcagaatcggtcatcactggcagtcgcaagcaggttatggtaagtacgatggcaaagcaaattttgaagtggactttggcgccaaacagttgaccggcacactgactgaaaaatcaggcattgagcctgcgtttaatctaaaagccacaattaatggcaatggatttagtggcacagccacctctcgttcaaatggcatctatttggatgaaggtcgtcagcaaaaccaacaaatcctaacagttgagagtaacaatctgactggagcattctatggcgagaatgccaaacacttgggtgggtcgttcagctttgaaaagaatctgagcgatgacgagacagttgttggtggtgcggtattctatggcacaaaaaccacagaagatgaaaagaaacagaagtaa

SEQ ID NO: 866 - protein, 946 aa, M. caprae
MPKSTKFSLLPLAVAVTSLMLSACGGGSFDNPSTIVIGQSRMIEKSDQSKNVSTDKADDNANANADTKNKADSRLTMPVLGSVLAIPKRNLALDKKKLTRLEEHVPLDENNIKTAHANPLPALTKELQERYKDEKIHQSDDKYKFVKAGWIFAGLRPYETITTDEDTDQPKRYTKGDGYLYYYGENPTTGLAKGVANYTGHWDFVTDVKRIRESPTKENTGRQAFGGGLAYRMDSGFGDEVGATSFAEQVFGQVSPRQGNHRAVFKADFDAKKLTGTLSTKQKAIASSPETYLDRYDIDATIKGNRFVGSAIAKNTETSFMKPNFFSKNADDRLEGGFYGENAEELAGKFLTNDNSVFAVFAGKQDNPEKVEKLEQVFGGAYVELTQDKAVNPAQKSQVLSLVNFGNVDQLQLGDHTITLLPQEAGKTTQQSVKLPTGQTAVITSFGSSDGVLRLGSVSKTAKTIETTAKSKPAENVKVTNKDKVGEPAKPTAEQLEAAKEKLTEKMDELKAELTILLDSYQKNSQDRATLRKQITEKVLLGYNDESSKKNVAEVLQDMFNSLVDSDEEEREWAADNILEMLVTGDKFNSDNLENLKEFLVQNSLAQSVPSHTQDQIAKAKADLKVKLETEKQELKDLLDIFAIENGNFNFGNNEESNETAQNPAEDDDERVNGATDSADEVASADVDDLEELKAEVIDKIKTAYTKDRQDVIGKQAVTLLEELKNGNEEASGKLVALFAQGDKFNSDNLENLTAYLPALPSTPDASTPEQSDAIPLIGIEDSLTGLYILGQRTPASQIANQGQASYQGTWHGRIGHHWQSQAGYGKYDGKANFEVDFGAKQLTGTLTEKSGIEPAFNLKATINGNGFSGTATSRSNGIYLDEGRQQNQQILTVESNNLTGAFYGENAKHLGGSFSFEKNLSDDETVVGGAVFYGTKTTEDEKKQK

SEQ ID NO: 867 - DNA, 2124 bp, M. catarrhalis
atgaaacacattcctttaaccacactgtgtgtggcaatctctgccgtcttattaaccgcttgtggtggcagtggtggttcaaatccacctgctcctacgcccattccaaatgctagcggttcaggtaatactggcaacactggtaatgctggcggtactgataatacagccaatgcaggtaatacaggcggtgcaagctctggtacaggcagtgccaacacaccagaaccaaaatatcaagatgtgccaactgataaaaatgaaaaaagcatgaaaaaagctgaagtttcagacatacaaaaacctgccatgggttatgcaatggaattaaagcttcgtaatgctcaccctgagaatccaaataaagagaccgaaaaacacatcgccttagaccaaaaagatttggtggcggtagagggcgacctaaccaatattccttttgataaaaatcttattgaataccttaaaaaatcacccgaggttgtaagtaaattcaatgaacaaaaaggcggtattgaaaataacacaaaattaacatacaaagattcattattatcatcagagcaaaaaaaagcaaaagtcaaagaagcgttggacaatgctttaactcaatttgcccaagaaaaatacaaggagctaattgagaatgcccatgataaaaaatctgacgcacgcaaccgtgacctaaaatatgtcaagtctggttttaactatctttctggatataccgccaccgaccacgataaaaaaccaattatcgtggctattatggtgcgttgtattataaaggcagtgaaaccgccaaagagttaccacaaacaagtgcaaaatataaaggttattgggactttaatgacagatgccacatttgataacaaatacacggatttgccaggtatcgccagacaaacccagtggcgtagtcttgtttctactgatgagtatgcaacgctcttgacagacaaaaataataagcccagtaattataatggtgcatatggtcatagcagtgaatttgatgttgattttgctaataaaaaagtcacaggcaaacttatcagtaatcagttatcaggcacggctgtaaccgccaaagagcgttataaaatagaagctgatatccacggcaaccgtttccgtggcagtgccaccgcaagcgataaagcagaagacagcaaaagtaaacacccctttaccagtgatgccaaagataggctggaaggtggtttttatggaccaaaaggcgaggagctggcaggtaaattcctaaccgatgacaacaaactctttggtgtctttggtgctaaacaagagggtaaagtagaaaaaaccgaagccatcttagatgcctatgcgcttgggacatttaataatacaaataaagcaaccacattcaccccatttaccaaaaaacaactggataactttggcaatgccaaaaagttggtcttgggttctaccgtcattgatttggtgcctaccgatgccaccaaagatgtcaatgaattcaccaaagacaagccaacttctgccacaaacaaagcgggcgaaactttgatggtgaatgatgaagttagcgtcaaaacctatggcaaaaactttgaatacctaaaatttggtgagcttagtgtcggtggtagccatagcgtctttttacaaggcgaacgcaccgctaccacaggcgagaaagccgtaccaaccacaggcacagccaaatatctggggaactgggtaggatacatcacaggaaaggacacaggagcgggctcatcaaaaggctttaccgatgccaaagatgttgctgattttgacattgactttgagaaaaaatcagttaatggcaaactgaccacccaaggccgccaagaccctgtatttagcatcacaggtaacatctcaggcaatggctggacaggcacagccagcaccaccaaagcgaacgcagggggctacaagatagattctagcagtacaggcaaatccatcgtcatcgaaaatgccgatgttactgggggcttttatggtccaaatgcaaacgagatgggtgggtcatttacacacgataccaatgacagtaaagcctctgtggtctttggcacaaaaaaacaagaagtcaaaccatga

SEQ ID NO: 868 - protein, 707 aa, M. catarrhalis
MKHIPLTTLCVAISAVLLTACGGSGGSNPPAPTPIPNASGSGNTGNTGNAGGTDNTANAGNTGGASSGTGSANTPEPKYQDVPTDKNEKSMKKAEVSDIQKPAMGYAMELKLRNAHPENPNKETEKHIALDQKDLVAVEGDLTNIPFDKNLIEYLKKSPEVVSKFNEQKGGIENNTKLTYKDSLLSSEQKKAKVKEALDNALTQFAQEKYKELIENAHDKKSDARNRDLKYVKSGFNYLSGYTATDHDKKPIIVAIMVRCIIKAVKPPKSYHKQVQNIKVIGTLMTDATFDNKYTDLPGIARQTQWRSLVSTDEYATLLTDKNNKPSNYNGAYGHSSEFDVDFANKKVTGKLISNQLSGTAVTAKERYKIEADIHGNRFRGSATASDKAEDSKSKHPFTSDAKDRLEGGFYGPKGEELAGKFLTDDNKLFGVFGAKQEGKVEKTEAILDAYALGTFNNTNKATTFTPFTKKQLDNFGNAKKLVLGSTVIDLVPTDATKDVNEFTKDKPTSATNKAGETLMVNDEVSVKTYGKNFEYLKFGELSVGGSHSVFLQGERTATTGEKAVPTTGTAKYLGNWVGYITGKDTGAGSSKGFTDAKDVADFDIDFEKKSVNGKLTTQGRQDPVFSITGNISGNGWTGTASTTKANAGGYKIDSSSTGKSIVIENADVTGGFYGPNANEMGGSFTHDTNDSKASVVFGTKKQEVKP

SEQ ID NO: 869 - DNA, 2847 bp, M. catarrhalis
ttgtctttttgccttgttgtgtgtttgtgggagttgattgtacttaccttagtggtggatgcttgggctgatttaataaagcggtcttcacaacacaccaaacgagatatcaccatgagtactgtcaaaaccccccatattttctaccaaaaacgcacccttagccttgccatcgccagtatttttgctgccttggtgatgacaggctgccgctctgatgacatcagcgtcaatgcacccaatgttacccaactgccccaaggcacggtttcaccaataccgaacacaggtcatgacaacaccaataacaccaacaatcagggcaacaacacggataacagtaccagcacaactgacccaaatggcgataacaaccaactgacacaagcacaaaaaactgccgccgccgcagggttttttgtgatgggtaaaattcgtgataccagcccaaaaaatgacccagattatggtgatgatttaaaacagcagtggctgggcaaattatatgttggtattgatgcccatcgcccagatggcatcggaaaaggtaaaaacttgcgtcagcccatcaccgccaatgacatcaaacccttgtattttaacaaattccctgcattgtctgatttgcacttagacagtgaacgccatcgttttgacccccaaaagataaacaccattaaagtgtatggttatggtaacttaacaacaccttccaacaataacactcacatcaatcatcagcaagctgataatgccaaagccaaaaagcccaccgatgcttatgaaaatatccgttttggatatcttgaactacaaggcagcagcctgacccaaaaaaatgccgataatcaaaatgaccaagaccgcattcccaaacccatgcctattttgttttatcatggagaaaacgccagcagccagctgcccagtgctggtaaatttaactacacaggcaactggctgtacctaagtgatgtcaaaaaacgccccgccctttcagcatcagatgatcgagtgggggtctatcttaatgccagtggcaaagccaatgagggcgatgtcgtcagtgccgcccacatttatctaaacggctttcaatacaagcacacgcctgccacttatcaggtggattttgacacaaactcattaacaggcaagctgtcctattatgataatcccaataagaaaactgcccaaggcgaatatctcaaaagccaatttgacaccagcaaaaaagtcaatgaaaccgatgtgtatcaaattgatgccaaaatcaacggtaaccgctttgtcggtacagccaaatctttggttaacgaaaacacaaaaaccgcaccttttatcaaagagctgttctccaaaaaagccaatcccaacaacccagaccccaactcagatacgctagaaggcggattttatggtaagtcgggcgatgagcttgcaggtaaatttttatccaatgacaacgcaacttatgtggtctttggcggtaaacgagacaaaacggctgaacctgtcgccacaaaaacggtgtattttagtgcaggctttgaaaaacccagcaccagttttgtggataatgaaacgattggtagaattattaacagtaaaggattaaatgataacattgaagaagatgcaattactcccagtgataatagttattatgaatataattggggcaagccagagaagcagttcaccaaaaaagtcagcagcagcacccaagccgtgccagcttattttgggcaacatgataaattttattttaatggcaactattatgatctatcagccagcagtgttgataaattggcccctgccgatgctgtcaaagccaaccaatccattaaagaaaaataccctaatgccacactaaataaagacaaagttaccaccatcgtgttacaagaagccaaagataataagccttataccgccattcatgccaaaagctatgaccacatcagttttggtgaagtattgtataatgataacaaaggcaacccaacacgcagttattttgtgcaaggcggtcaagcggatgtcagtactcagctgcccagtgcaggtaaattcacctataatggtctttgggcgggctatcttgcccagaaaaaagacaaaggttatagcaataaagaagagaccatcaaggcaaaaggtcatcaagattatctgttaaccgaagacttcaccccagaagatgatgacaatgatttgattgcatctgatgattcacaagatgataatacacatggcgatgatgatttgattgcatctgatgattcacaagatgataatacacatggcgatgatgatttgattgcatctgatgattcacaagatgatgacgcagatggcgatgacgattcagatgatttgggtgatggtgcagatgatgacgccgcaggcaaagtgtatcatgcaggtaatattcgccctgaatttgaaaacaaatacttgcccattaatgagcctactcatgaaaaaacctttgccctagatggtaaaaataaagctaagtttgatgtggattttgacaccaacagcctaactggtaaattaaacgatgagagaggtgatatcgtctttgatatcaaaaatggcaaaattgatggcacaggatttaccgccaaagccgatgtgccaaactatcgtgaagaagtgggtaacaaccaaggtggcggtttcttatacaacattcaagacattgatgttaaggggcaattttttggtacaaatggcgaagagttggcagggcagttacagtacgacaaaggcgatggcatcaatgacaccgccgaaaaagcaggggctgtctttggggctgttaaagataaataa

SEQ ID NO: 870 - protein, 948 aa, M. catarrhalis
MSFCLVVCLWELIVLTLVVDAWADLIKRSSQHTKRDITMSTVKTPHIFYQKRTLSLAIASIFAALVMTGCRSDDISVNAPNVTQLPQGTVSPIPNTGHDNTNNTNNQGNNTDNSTSTTDPNGDNNQLTQAQKTAAAAGFFVMGKIRDTSPKNDPDYGDDLKQQWLGKLYVGIDAHRPDGIGKGKNLRQPITANDIKPLYFNKFPALSDLHLDSERHRFDPQKINTIKVYGYGNLTTPSNNNTHINHQQADNAKAKKPTDAYENIRFGYLELQGSSLTQKNADNQNDQDRIPKPMPILFYHGENASSQLPSAGKFNYTGNWLYLSDVKKRPALSASDDRVGVYLNASGKANEGDVVSAAHIYLNGFQYKHTPATYQVDFDTNSLTGKLSYYDNPNKKTAQGEYLKSQFDTSKKVNETDVYQIDAKINGNRFVGTAKSLVNENTKTAPFIKELFSKKANPNNPDPNSDTLEGGFYGKSGDELAGKFLSNDNATYVVFGGKRDKTAEPVATKTVYFSAGFEKPSTSFVDNETIGRIINSKGLNDNIEEDAITPSDNSYYEYNWGKPEKQFTKKVSSSTQAVPAYFGQHDKFYFNGNYYDLSASSVDKLAPADAVKANQSIKEKYPNATLNKDKVTTIVLQEAKDNKPYTAIHAKSYDHISFGEVLYNDNKGNPTRSYFVQGGQADVSTQLPSAGKFTYNGLWAGYLAQKKDKGYSNKEETIKAKGHQDYLLTEDFTPEDDDNDLIASDDSQDDNTHGDDDLIASDDSQDDNTHGDDDLIASDDSQDDDADGDDDSDDLGDGADDDAAGKVYHAGNIRPEFENKYLPINEPTHEKTFALDGKNKAKFDVDFDTNSLTGKLNDERGDIVFDIKNGKIDGTGFTAKADVPNYREEVGNNQGGGFLYNIQDIDVKGQFFGTNGEELAGQLQYDKGDGINDTAEKAGAVFGAVKDK

SEQ ID NO: 871 - DNA, 792 bp, M. granulomatis
atgaaaaaattagcaaaactcagccttacattattagcagtcaccgtaatttcggcatgtggtagttctggcggtagtagcgacaattctaattcacaagcaactccatcaaaaccgactgtaaccactacagctccgacgaagcagacaaccaccaatccaacaacaaaacctaccacaacgaaaccaacaacatcaactagctctagcgacaaaatgggaacagctttccgcgttaacgatagtaaagagttcgatattaaaaaagcctcaacatataaaacagaattagtagttgacagtaaaacattacctgtagcttggaatggcattgtatcgggtggattcacaaaactaagcaatgcaacaatcaatggggtaacttataaagactttaccgttagtggtgcaagatattcttctgtaaaatttggtcatattgatggctacgtatttacacaaggagatgtaacaccaaaagctagtattccaaccagcggcaacgcaacttatcttgtggatggtgtttttgttgcaaacggtaaaacctcaacttcccaaggtcatagcctaaacgttgattttgcgaataaaactttaaatggtactatcgcaactgatgtaacagtaacaaacgctaaaatcagtggcaatgaatttgaaggtaaagccgtccataatggtaaatcagcagaactagaagggcatttctatggctcaaatgctgctgaaattggtggaacttatagctcatcgaacttctcaggtgcatttggcggtaaaaaacaataa

SEQ ID NO: 872 - protein, 263 aa, M. granulomatis
MKKLAKLSLTLLAVTVISACGSSGGSSDNSNSQATPSKPTVTTTAPTKQTTTNPTTKPTTTKPTTSTSSSDKMGTAFRVNDSKEFDIKKASTYKTELVVDSKTLPVAWNGIVSGGFTKLSNATINGVTYKDFTVSGARYSSVKFGHIDGYVFTQGDVTPKASIPTSGNATYLVDGVFVANGKTSTSQGHSLNVDFANKTLNGTIATDVTVTNAKISGNEFEGKAVHNGKSAELEGHFYGSNAAEIGGTYSSSNFSGAFGGKKQ

SEQ ID NO: 873 - DNA, 606 bp, M. granulomatis
atgaaaaaactacttctttgttcagtggccggcttatctgttttattaactgcttgtggtggaggtggaggcagtggatctgctaaaacgcctgatggtactaaagtggatttaacaaatagccaaaaaggcgatgttgctggtaatacagcagcgggttctttatatggaaaaaaccagaatgattcattttatggcgtatggttaaatgatgctaaaacagtgagagaattacgttatcaaggtacggaggccacaaatctaccttcaggttctgcaacttatgtaggtgaatcttactggatgagtggcacaacaggtgaagtatcaaaaggtggtgtaacaacccttaatgtagattttgaccaaaaaacggtagatggaaaaattgaatattcattgctaagagacggtagaactcaagacattactctacattcaacatccttaaatggtacaaaatttaatggtaatgcaagtacgttattgcaaaatggtacttatgaaggcgcattatttggcaaagaggctaaagaagctgcgggattggtgaagttccctaattcaagctcttacgatacttcatttggtggcgttcgttattaa

SEQ ID NO: 874 - protein, 201 aa, M. granulomatis
MKKLLLCSVAGLSVLLTACGGGGGSGSAKTPDGTKVDLTNSQKGDVAGNTAAGSLYGKNQNDSFYGVWLNDAKTVRELRYQGTEATNLPSGSATYVGESYWMSGTTGEVSKGGVTTLNVDFDQKTVDGKIEYSLLRDGRTQDITLHSTSLNGTKFNGNASTLLQNGTYEGALFGKEAKEAAGLVKFPNSSSYDTSFGGVRY

SEQ ID NO: 875 - DNA, 921 bp, M. granulomatis
atgtttatgaaaaaaataacattggccagcttaattttatttagtctaacggcatgtagtggttcgggtggtggctctaatgcaaaatcacctaaccagaaaattacagagcaaaaacaagggctaaaagataaggcagataaagcaaaaactgatgcagaacgtttagcaaaagagaaagctgaaaaggcgaaagcagaagcagagcgtttggcgaaagaggctgaaaaagcgaaaaaagaagcagagcgtttagcaaaagaaaagtctgaaaaagcgaaagcagaagcagagcgtttagcaaaagaggctgaaaaagcaaaagcggaagaagctaaaaaaattattgatgctaaaggcgttgatgataaaaactatggactaagaaaattagaggactcggttaaacctaacactaataatggagaggttagaacctatggttatctctataatcagccttattctgttgttactgctcggatgacaaccacagtaggtgcgaatttaaatcaacttgagccaacggttgaagtaagagggttaaagacagaacagttacctactgaaggtaaagctatttatcaggggaagtcttttgattctcatggtgataaaggagtatatggtggtagtttaacttataatgttgattttgcgggacgtaaaggttcaggtgaaatagttaatatattagggggatctattaagttaggcgagggtatgataaatactaatggtgcaatttcttctactgttactcatactgcagctcaaaataatgttgttcataatggaacctacgaggttcaattctttggacctaatgcagaagaaatcggtggtaaagtagagattaaagatggagagagaacagatcgctttggtattagcggaactcgaggcgaaattcaaaaataa

SEQ ID NO: 876 - protein, 306 aa, M. granulomatis
MFMKKITLASLILFSLTACSGSGGGSNAKSPNQKITEQKQGLKDKADKAKTDAERLAKEKAEKAKAEAERLAKEAEKAKKEAERLAKEKSEKAKAEAERLAKEAEKAKAEEAKKIIDAKGVDDKNYGLRKLEDSVKPNTNNGEVRTYGYLYNQPYSVVTARMTTTVGANLNQLEPTVEVRGLKTEQLPTEGKAIYQGKSFDSHGDKGVYGGSLTYNVDFAGRKGSGEIVNILGGSIKLGEGMINTNGAISSTVTHTAAQNNVVHNGTYEVQFFGPNAEEIGGKVEIKDGERTDRFGISGTRGEIQK

SEQ ID NO: 877 - DNA, 1458 bp, M. haemolytica
atgcgttctacattcaaacttactcttgcagctttagctgtttctattgttttaagtggctgtaaatctagccaaggtccatctattgttgcagacagccctccacctaaggaaataacagctactgatggcaacgataaagagaaaaccgataacaaagagaaaaagtctgcgcaaccaaataaatccgatcctcaaccggataaacctgctaacgcaaaagacccagtaaaacctgatgcggagacaaataaaccaagtaaaaaagataaagaatatacaccacctgctactgaaaaaatcgataactcatcagtacagccggataaaatggtgcctaatcctatcgagaataaggaaaacgacagtaataaacctaaccccaaagaaagcgatagcgataataatgacaaagtcactgaaggcaataaaccaaatgccccaacagaaacagtaaataaagataaagaagctgagaaaagtaaaaaggagaataaagaggactcaagcaataatactcctaacattaattttgacggggcaaagcctatagatacagatagtaaaggtagcccgtaccgagtaataaacctaaatccgagaaaaagcgtagtaaatgcaagtgctatgcaaaaagtagatttcgactcttttacggatgaatctgttgaaaattcaccatttgtcagtagcgatactgaaaaagaatacaataatacacttgtttttgggcttggtgccggagataaagattcttattttaagaacttaaatcaaaaaggggataaacatttaggtattcatagtggcgtgtatgaagatgcgaatttagaaggtaatactaaaaaaattaactatctctatgtaaatcaaccttattcgagctatggtgctttatttacggaccaaaaagacagccatttattcaacgttcgtctgaccgctggtagagatgatgtaaaagaaaatggagatagttatgccgaatatggtgtattcacacaatcaggaaaagaagctaaatggaatgataacctgattggtgatgccacttacaaaggtcaagctattgctcgcgttattcgtcaggtaaatggggaacaagtcgcaggtattcctcaatttgatggtgatgttacattaaatttacacctttccaaagaatggaatgaaagtaaactaaacggcaaaattgatagccaaagtgttggggtaattacacttaaagaaagtgaaatagctaaccctaccgcactccgctcaaatattggttttggagaagaagtcatagttgagaataaagagaatcttgtgggtgattacgctgtcgattttaccgggcctcagcttgaagaggcggtaggcgttgttgaattagaaaacgaagccgagacattctctgaaaatgaagtcattaaatacaatgcggtatttggcgtaagcaaagcggcgaaatag

SEQ ID NO: 878 - protein, 485 aa, M. haemolytica
MRSTFKLTLAALAVSIVLSGCKSSQGPSIVADSPPPKEITATDGNDKEKTDNKEKKSAQPNKSDPQPDKPANAKDPVKPDAETNKPSKKDKEYTPPATEKIDNSSVQPDKMVPNPIENKENDSNKPNPKESDSDNNDKVTEGNKPNAPTETVNKDKEAEKSKKENKEDSSNNTPNINFDGAKPIDTDSKGSPYRVINLNPRKSVVNASAMQKVDFDSFTDESVENSPFVSSDTEKEYNNTLVFGLGAGDKDSYFKNLNQKGDKHLGIHSGVYEDANLEGNTKKINYLYVNQPYSSYGALFTDQKDSHLFNVRLTAGRDDVKENGDSYAEYGVFTQSGKEAKWNDNLIGDATYKGQAIARVIRQVNGEQVAGIPQFDGDVTLNLHLSKEWNESKLNGKIDSQSVGVITLKESEIANPTALRSNIGFGEEVIVENKENLVGDYAVDFTGPQLEEAVGVVELENEAETFSENEVIKYNAVFGVSKAAK

SEQ ID NO: 879 - DNA, 1176 bp, M. haemolytica
atgtctatcaaaaaagtaactttagccagtttgattttattgggtttaacggcgtgtagtagtggtggttcgggcagtagctcaaacaatgtggcaaaaccgaatactaaaccgcaaactactcagcaacaaaccgataaagcggcagcagaaaaagcagcaaaagacaaggcagcgaaagagaaagcagaagcagaacgtttagcagcagaaaaagcagctaaagagaaagcggaagcagaacgtttagcggcggaaaaagcagcgaaagaaaaagccgaagcggaacgtttagcggcggaaaaagcagcgaaagaaaaagccgaagcagaacgtttagcggcagaaaaagcggcgaaagagaaagcggaagcggagcgtttagcggcggaaaaagcagcgaaagaaaaagccgaagcagaacgtttagcggcggaaaaagcggcgaaagagaaagcggaagcggagcgtttagcggcggaaaaagcagcgaaagaaaaagccgaagcagaacgtttagcggcggaaaaagcggcgaaagagaaagcggaagcggagcgtttagcagcagaaaaagaagtagatcctatagctattattaaagcaaaaggtattgatgatacaaattacggcttaaaacttggtaatagtaaagaaactattgagggtaaagtcacagtcagaacacagagttatttatataatcagccatattctgtagtaacagcacaagcagttcaaagaaatggctgggaaaacggtaattatattgataaagttgatggaacagttacagttaaaggattgaaaacagagaaattaccaacagagggtactgcaacatattcaggaaaagcatttaaccacgatggagctaaaggttttaatggtggtgatctaacctataatgttaatttctctaagcgtaccggttcaggtagagttgagggagaatttggaaacttaatcgtattagaagaggggacgattaataatactcagatttcttcaacagtacatggcaataatcctttaaacctttctggaaaatatacagtcgaatttttcggtaaaaatgcagaggaaattgccggtgaaattcagacaaaagcaaatcttactggggaagtgagtaattttggacttgccggcactcgtggcgatatccaaaaataa

SEQ ID NO: 880 - protein, 391 aa, M. haemolytica
MSIKKVTLASLILLGLTACSSGGSGSSSNNVAKPNTKPQTTQQQTDKAAAEKAAKDKAAKEKAEAERLAAEKAAKEKAEAERLAAEKAAKEKAEAERLAAEKAAKEKAEAERLAAEKAAKEKAEAERLAAEKAAKEKAEAERLAAEKAAKEKAEAERLAAEKAAKEKAEAERLAAEKAAKEKAEAERLAAEKEVDPIAIIKAKGIDDTNYGLKLGNSKETIEGKVTVRTQSYLYNQPYSVVTAQAVQRNGWENGNYIDKVDGTVTVKGLKTEKLPTEGTATYSGKAFNHDGAKGFNGGDLTYNVNFSKRTGSGRVEGEFGNLIVLEEGTINNTQISSTVHGNNPLNLSGKYTVEFFGKNAEEIAGEIQTKANLTGEVSNFGLAGTRGDIQK

SEQ ID NO: 881 - DNA, 825 bp, M. haemolytica
atgaagagtatcaaaaaattaaccctagccactttgattttagtgggtttaactgcttgtggtagcggtggttcaggtagcagttctaataatgctaaatcgaaaccacaagttgagttaaaaaaaactgaagaggataaaaaaactgaagaggataaaaaaactgaagaggataaaaaaactgaagaggataaaaaaactgaagaggataaaaaggctgaagaagcaaaaaaaattgcagaggcaaaaggaattggcaataaagaatataaagatggattaaatgagttagaagaaaaaaatgaaacaggtaaaaacggagaagagattcgaacccatggttatctctataacagccattattccgttgtaactgccaaaatgaaacaaactttacaggaaaatggtcgtcaaatggaacctacggttgaagtgaaagggcttaaaactgagaatttaccgacagagggcaaagcaacatataaaggagaagcctttgattctcacggtaataacagcaattcagtagtaggtggagaattaatctataatgttgatttctctagtcgtaccggatcaggtctagttaaaaatgtacagggcggttctatcgagttagcacaaggcgaaataaaaaatgatagtattatagcttctgctcaccaaaagtataatgatcaggctgttggaaatggtagttacaatatccaattctttggtccaaatgcagaagaaattggagggaaaattgagcttaatggtgagggcgaaggctcaatgaagcagatgttaggtattgcaggaacccgagaagaacaaaaataa

SEQ ID NO: 882 - protein, 274 aa, M. haemolytica
MKSIKKLTLATLILVGLTACGSGGSGSSSNNAKSKPQVELKKTEEDKKTEEDKKTEEDKKTEEDKKTEEDKKAEEAKKIAEAKGIGNKEYKDGLNELEEKNETGKNGEEIRTHGYLYNSHYSVVTAKMKQTLQENGRQMEPTVEVKGLKTENLPTEGKATYKGEAFDSHGNNSNSVVGGELIYNVDFSSRTGSGLVKNVQGGSIELAQGEIKNDSIIASAHQKYNDQAVGNGSYNIQFFGPNAEEIGGKIELNGEGEGSMKQMLGIAGTREEQK

SEQ ID NO: 883 - DNA, 2571 bp, M. macacae
atgaccacatctaaaacccccaaaatgtttaaaaaatcacaccttgcccttgctgttgccagcacctttgccgcccttgctttgaccggttgtggtggcgacagtattaaatccgccgcccccaacatcaccaccttgccaaaaggcacggtaccgcctgcagttgccaatcccaataaaccggataacaataacaacggtggaagcgataacaataacggcggaagcggtggtaacgataacaacggtagcggtagtgataataaccaagcacaaaccccgcaaaacccacaaacccagcctgccgcgggcttttttatggtgggtaaaatccgcgacaccagtaaaaccaataatccagaacgcaccgatgcatcgcaatatcttggcacggataaaatattacccgatggcacaaccgcaggcacaaatttgcgccaagcactcaccgaaaacgacattaaacccatgaattttaaccaattccccacttggcaacaattgcacattgacagtccaacgcatgcactcaaaggtgattggcttaaacgcgccaaagtttatggttatggcaaactttcacccttaaacgaccaaaacaatactcatattaatcacttacaagacgaaaataaaaaagccaaaaaatccgccgataattatgaacacattcgttttggttatttagacatcgcaggtttaggcttaaaccaaaaagcaggtgaaaaaaacctccacaatggtaaaatgccgattttattttatcatggtgataacgttagcacacaattacccagtgctggcacgtttgaatacaaaggcaattggctgtatttaagtgatgtcaaaaaacgccctgccctaactggcaaagatgaaaaagttggcacttattttaacgcttacagcaaaaccaacgaagctgatgaaattagtgccgcccatatttatctaaacaacatgaagtacaaacacacgccggctacttataaagtggattttgataaaaacaccttaacaggtaaattatcgtattatgacaatcccaataaacaaaacagcagtggcaattatattgccagccaatttgacaccaccaaaaaagttaatgaagtagatgtttatcaaattgacggtaaaattcaaggcaaccgctttaccggtacagccaaatcattaattaccgaaaacagcaaaaccgcgccgtttattaaagaattgttttctaaaaaagccaatcccaataatcccgacccagattcaaatgccctagaaggcggcttttatggtgaaacgggcgatgaattggcgggtaaatttttatccaatgatggctcggcgtatgtggtatttggcggcaaacgcaatgataaaaacaaaaaacccgaaacaaaaccgttttattttagtgcaggctttgaaaaaccgattattagcaatatttctaatgaagatattggcaaagtgattgaaaagaaaaaactaaatgaagaaattgatgcaaagattgacgagggcgaaataccaattagcgatgaccaatatgaatcttacccttggggcaagccacaagctgatttcaccaaacaaaccagtaccagtaaacaagtcattcctgcttattttggacaacacgataagttttattttaatggcaattattacaatttaaaggcaaactcaaaagataatttagaagtaaaaaatgccaataacacacaaactattaaaaataaataccctgatgtaaaagttgagcaaaaagacaatgtaaccaaaatcaccttacaagaaaaacaaggcgataaaccttataccgcgattaatgccaaaacttacaatcatattagctttggcgaagtattgtataacgatgacaaaaataacccaacgcgcagttattttgtgcaaggcggcgaccaagagcaaaccaccactttaccaagtgcaggtaaatttacttataacggcttgtgggcgggatatttgattcagaaaaaagataaaggttttagcaataatgaagacataattaagaaaaaaggacataaagattatatcttagcccaagattttaccccagagtcagaagaagatgaagaagaaaatgacgaagagagcacagatactgataaaacctatcttaaaggcgagattaaacctgaataccgtgataaatatctaccaataaacgaaaaaacccatcaaaaaacgttttcattggatggtaaaaataaagccagttttgatgtggattttgataccaatactttaaaaggtgcattaaccgatgaaaatggtcatagcgtgtttgatattaaagacggtaaaataaatgacacagggtttaccgccaaagccgatgttaacaattaccgcgaagaagttggcaataccaatagcggcggttttttatatgacataaaagacattgatgtcaatgggcaattctttggcactgatggcgaagaattggcaggacaattgcattatgataaaggcgacggcgtaaccgaagaagtgaaaaaagcgggcgcggtatttggtgcggttaaaggcgataaaaaataa

SEQ ID NO: 884 - protein, 856 aa, M. macacae
MTTSKTPKMFKKSHLALAVASTFAALALTGCGGDSIKSAAPNITTLPKGTVPPAVANPNKPDNNNNGGSDNNNGGSGGNDNNGSGSDNNQAQTPQNPQTQPAAGFFMVGKIRDTSKTNNPERTDASQYLGTDKILPDGTTAGTNLRQALTENDIKPMNFNQFPTWQQLHIDSPTHALKGDWLKRAKVYGYGKLSPLNDQNNTHINHLQDENKKAKKSADNYEHIRFGYLDIAGLGLNQKAGEKNLHNGKMPILFYHGDNVSTQLPSAGTFEYKGNWLYLSDVKKRPALTGKDEKVGTYFNAYSKTNEADEISAAHIYLNNMKYKHTPATYKVDFDKNTLTGKLSYYDNPNKQNSSGNYIASQFDTTKKVNEVDVYQIDGKIQGNRFTGTAKSLITENSKTAPFIKELFSKKANPNNPDPDSNALEGGFYGETGDELAGKFLSNDGSAYVVFGGKRNDKNKKPETKPFYFSAGFEKPIISNISNEDIGKVIEKKKLNEEIDAKIDEGEIPISDDQYESYPWGKPQADFTKQTSTSKQVIPAYFGQHDKFYFNGNYYNLKANSKDNLEVKNANNTQTIKNKYPDVKVEQKDNVTKITLQEKQGDKPYTAINAKTYNHISFGEVLYNDDKNNPTRSYFVQGGDQEQTTTLPSAGKFTYNGLWAGYLIQKKDKGFSNNEDIIKKKGHKDYILAQDFTPESEEDEEENDEESTDTDKTYLKGEIKPEYRDKYLPINEKTHQKTFSLDGKNKASFDVDFDTNTLKGALTDENGHSVFDIKDGKINDTGFTAKADVNNYREEVGNTNSGGFLYDIKDIDVNGQFFGTDGEELAGQLHYDKGDGVTEEVKKAGAVFGAVKGDKK

SEQ ID NO: 885 - DNA, 873 bp, M. mediterranea
atgaacaagatttttctggctgctctggcaggcaccgcaatgatcgcgatggctggatgcagcagcacgtccggaaacagttctccggggaacccgggcactggcggcggcggctcgcaggggggagaacccagcggtggtgacggcaactacacagtcggcggaaccaccgttcaactcaggaacggatccgtcacctcggttgccgatacgacaggtgactacaccgaagatgacaatggtaatctttccgtcagcttcacgtccgggccctatgccggccagagcgtgtccttcagcgagggcagtgacacagccgatctggacggccagacggcgacactggaagcgttccttggttccgacaatgacaacagcacatcgggcgcgctctacatcaccgttgacggcgagaatgatgaggggaacggcaacttcctcgctctttacagcggcgataccgtatccgatctgccgcaggaaggcaccggcacttaccggggcgactatttcggcagtgcacagaacggtgaggccggcggcctggtttcgggctccagcgaaatcgccgtcgactttcagagcggcgcggtttcaggcgatttcagcgacctgaccatctatgacggcgacgatgcaatcggcgcgatggacgatgtcggctttgccgggacgcttgacaagaacagtgcctcctatgttgccaacagcgtgacgatcgggggcgcagcggccggcgaaggttccttggtccagggttcgctttatggcgccggagccgattcgactgctggcagcgtggccgccttcgacaatgccgacaacccgacaaaggctaccgtcggcgtgtttcaggcggacctggcagactga

SEQ ID NO: 886 - protein, 290 aa, M. mediterranea
MNKIFLAALAGTAMIAMAGCSSTSGNSSPGNPGTGGGGSQGGEPSGGDGNYTVGGTTVQLRNGSVTSVADTTGDYTEDDNGNLSVSFTSGPYAGQSVSFSEGSDTADLDGQTATLEAFLGSDNDNSTSGALYITVDGENDEGNGNFLALYSGDTVSDLPQEGTGTYRGDYFGSAQNGEAGGLVSGSSEIAVDFQSGAVSGDFSDLTIYDGDDAIGAMDDVGFAGTLDKNSASYVANSVTIGGAAAGEGSLVQGSLYGAGADSTAGSVAAFDNADNPTKATVGVFQADLAD

SEQ ID NO: 887 - DNA, 795 bp, M. mediterranea
atgaaatatctgacatgtgtcgtgctgggcgcggccgcgcttgcggctggctgtggcaacaatggcaatgatggcatcgcgaccaacgcgcttggctattatggcgacgtgaactgggacacgggccggatcgacgggtcggggacggcagaggccggtattcagatcaacgacgatgacagcgtgaccgttcagatcaacgagggtccgtatgccggggaaaccacaaccttctattacgacggcgcgggcggctatacgaccgacgacgccgaggcctatctgcagctcggttatttcgacaatccgaacgtcaaggatggcccggtggtggccctgatcgacgtcaatgacaacgacgaagagctcaccctgatggcgcttcgctcgagcaacgacatgaccgctgaatccgacatgccggtcacgggctttgcgacctataccggcagccatctgggcggagcgacgatcccgggccagtatctcgattatatcgagggcggtttccaggccaatgtcgatttcggcgccggtcagcttgcgggcgccatgcaaagcgatctgggcgacattaccttcgatgccaccatttccggggccgagttcaactcgaacgccaattcgatcgcgatcggcaatgattacggcgtcatcaaccagggggcttccggcgtcgagggcgggttctacggtgccggcgctgcaggcatggcggggacctatctgctgaacggtcaggggtcgctggatggcgcaggcgccgtcggcgccttcgtcgccgatcggaactga

SEQ ID NO: 888 - protein, 264 aa, M. mediterranea
MKYLTCVVLGAAALAAGCGNNGNDGIATNALGYYGDVNWDTGRIDGSGTAEAGIQINDDDSVTVQINEGPYAGETTTFYYDGAGGYTTDDAEAYLQLGYFDNPNVKDGPVVALIDVNDNDEELTLMALRSSNDMTAESDMPVTGFATYTGSHLGGATIPGQYLDYIEGGFQANVDFGAGQLAGAMQSDLGDITFDATISGAEFNSNANSIAIGNDYGVINQGASGVEGGFYGAGAAGMAGTYLLNGQGSLDGAGAVGAFVADRN

SEQ ID NO: 889 - DNA, 780 bp, M. morganii
atgaatacatttaatatgaaaaccccgctggcgacactggttaccctgtgtgccgcattctccgcggtacaggctcaggctgatgcgggctatggatcatcatctgccgaaggcttaagtaactatatatctgtcggcgtaaccgctgcatcagagcgtcaggggcatccgtcaccgggcggagaaccgggaattggttattccggcatgcacaacggaaccaaagtcagctttgccggactgcagggacccaaccgtgcaacaccaaacgataacggtgtttctgttatcacctcaactccgcagtcacaccgcagtatgggctcttttaattttgccaaaatagccgatgccgatatttattacggtgaatgggtttccggtactgatttcagcgatgattcccatatggtgtattacgccgggaaagatattaccgccgccatgccatccgaagggacggcacagtacagcattaaaggactcagcgggtacagcagcggtgaacagatcagcggtacatttagtacggattttgatgccaatacctttagcggctctctaagctcaaccgagctcagctacagcctgagcggggatatcagtggttcaacctttgatggaaccgcatctgtcagcaccaccggtaccgataccacagccgtcagcggtacgaccaacgggcatttctttggtgacaatgcacagcaggttgccggttatgctgagttcagcagtgataaagcgaagaatatcgcgttcggcggaaccaagtcttaa

SEQ ID NO: 890 - protein, 259 aa, M. morganii
MNTFNMKTPLATLVTLCAAFSAVQAQADAGYGSSSAEGLSNYISVGVTAASERQGHPSPGGEPGIGYSGMHNGTKVSFAGLQGPNRATPNDNGVSVITSTPQSHRSMGSFNFAKIADADIYYGEWVSGTDFSDDSHMVYYAGKDITAAMPSEGTAQYSIKGLSGYSSGEQISGTFSTDFDANTFSGSLSSTELSYSLSGDISGSTFDGTASVSTTGTDTTAVSGTTNGHFFGDNAQQVAGYAEFSSDKAKNIAFGGTKS

SEQ ID NO: 891 - DNA, 750 bp, M. morosus
atgaaaccacaaataaccgcaacggtccacaacctgttttatcgcaaaattacccgttatggtttttgtttggtgctgggctatttgttatcaggctgcgcaacgcaacccggccctgttgccaccgaaggcgcgacgacttcccgtgccttaatcttggcggtttgggattttgacaataattccatggcgggtggcgatgttgactatctcagtaaggcgctttcggaaatgttgataaccgacctttcgcaggtctcggatatgcgtttggtggagcgggtaaacttacgggcggcattggaagagcagcatcttagcactagccaactcgcatccgatgaaacccggctgaaattaggcaggatagcaggcgccaacctgctggcattcggtagttatatggcgatggctggtcaagtcaggattgacgtcagggtggttgatgcagaaacctcgctagtaaagtttagtgaagctacgtcaggttcgccgcaagacgcagccaaacagatgcagacgatagccgtgcatcttgccagtaaattggatgccagtgttatttctggaaaagaaaacgccacggacatgatgctttggaagcgttatgaagaagggatttctttgatggacaagcatctttacgaaccggcaattacaatatttaaagagatactgcaagctaaccctagctttgctgcggcagaaaagcagatcaaattggccttagaattgcaaacaagacaataa

SEQ ID NO: 892 - protein, 249 aa, M. morosus
MKPQITATVHNLFYRKITRYGFCLVLGYLLSGCATQPGPVATEGATTSRALILAVWDFDNNSMAGGDVDYLSKALSEMLITDLSQVSDMRLVERVNLRAALEEQHLSTSQLASDETRLKLGRIAGANLLAFGSYMAMAGQVRIDVRVVDAETSLVKFSEATSGSPQDAAKQMQTIAVHLASKLDASVISGKENATDMMLWKRYEEGISLMDKHLYEPAITIFKEILQANPSFAAAEKQIKLALELQTRQ

SEQ ID NO: 893 - DNA, 1017 bp, M. varigena
atgtctatcaaaaaagtaacattagcaagtttgattttattgagtttaacggcttgtggtagtggcggctccggtggcaactcaaacaatgcaacaaaaccgaatgctaaaccgcaaaccactcaacaacaaaccgataaagccgctgccgaaaaagcggctaaagagaaagcggaagcggaacgtttagcggcagaaaaagcagcgaaagagaaagcagaagcggaacgtttagcagcggaaaaggcagcgaaagagaaagcggaagcagagcgtttagcagccgaaaaagtagcgaaagagaaagcagaagcagagcgtttagcagccgaaaaggcagcaatagaaaaagcggcgaaagaggaagcggaacgtttagcagcagaaaaagcagcgaaagagaaagcagaagcagagcgtttagcaattgttaaagcaaaaggcattgatgatgaaaattacggtataagatttaatgattttaacgaaaaaacagaaggaaaaatcaaagttagaacacaaagctacttatataatcaaccatattcagttgttacagcacaagaggttaaaagaacaggctgggaaaatggaaaatatattgatatatcagataaaacaattacagttaaaggattaaaaacagaaaaattaccacctgaaggtaaagcaacttatgaaggaaaagcttttaattataatggggattatgacggtgcaatcggtggtcatttaacatacgatgttgattttactaatcgtactggttcgggaaagatagagggaggttatgctagaagtataacattggctaaaggaaatttagaaaaaaatagtatttcatctactgctagtctttattatggaactcatcatcatggtgatggaagctataaggtagaattttttggtccaaacgcagaagaaattagtggctatataaaaatggaaacagatattaatgggaatccagatagctttggtttctcaggcattcgtggagaagtccaaaaataa

SEQ ID NO: 894 - protein, 338 aa, M. varigena
MSIKKVTLASLILLSLTACGSGGSGGNSNNATKPNAKPQTTQQQTDKAAAEKAAKEKAEAERLAAEKAAKEKAEAERLAAEKAAKEKAEAERLAAEKVAKEKAEAERLAAEKAAIEKAAKEEAERLAAEKAAKEKAEAERLAIVKAKGIDDENYGIRFNDFNEKTEGKIKVRTQSYLYNQPYSVVTAQEVKRTGWENGKYIDISDKTITVKGLKTEKLPPEGKATYEGKAFNYNGDYDGAIGGHLTYDVDFTNRTGSGKIEGGYARSITLAKGNLEKNSISSTASLYYGTHHHGDGSYKVEFFGPNAEEISGYIKMETDINGNPDSFGFSGIRGEVQK

SEQ ID NO: 895 - DNA, 606 bp, M. varigena
atgaaaaaactacttttttgttcagttgcaactttatctgttttattaaccgcttgtggtggtggcggtggtagcggaaaagctgaaaccccagatggtactaaggttgatttaaccaatagtccaaaagatgatgtagcaggtaaaaccgttggaggtgaattctatggtaaaaaccaaaatgactcattctatggggtttggatcaatgatgcgaaaacggtaagagaattacgttatcaaggtacagaagctactcaacttccgtctggatcagcaacttatttcggtgattcttattggttaagtggtgcaactggcgaggtatctaaaggtggtaaaactacgttgaatgtggattttgaccgtaaaactgtagatggaaaaattgaatactcactgttaaatgatggtagagttcaagatattaccttgcacgaaacatcattaaatggttcaaaattcaatggcgaggcaagtacgcttttagagaagggcacttatgaaggggcgttatttggtcaaggtgcgaaagaagcagcgggcttagtgaaatttcctaaagctccttcttatgatacttctttcggcggtattcgctattaa

SEQ ID NO: 896 - protein, 201 aa, M. varigena
MKKLLFCSVATLSVLLTACGGGGGSGKAETPDGTKVDLTNSPKDDVAGKTVGGEFYGKNQNDSFYGVWINDAKTVRELRYQGTEATQLPSGSATYFGDSYWLSGATGEVSKGGKTTLNVDFDRKTVDGKIEYSLLNDGRVQDITLHETSLNGSKFNGEASTLLEKGTYEGALFGQGAKEAAGLVKFPKAPSYDTSFGGIRY

SEQ ID NO: 897 - DNA, 1203 bp, M. varigena
atgagtattaaaaaattaaccttagcaagtttgatcttaattggtttaacagcttgtggtagcagtggttcaggtagtggttcaaatcataaatcgcctgagcagaagattacggaacaaaagcaacagctaaaagataaagctgatacagcaaaagtggaagcggaacgcttgaagaaacaagctgaaaaagcaaaagaaaaagcagaaagtctggcaaaagaggcagaaaaagcaaaaacagaagcggaacgtttagcacaagaaaaagcagaaaaagcgaaggctgaagcagagcgtttggcaaaagaagcagaaaaagcgaaaatggaagcagaacgtttagcgaaggaaaaggtagaaaaagcaaaaacagaagcggaacgtttagcacaagaaaaagcagaaaaggcgaaagctgaagcagagcgtttggcaaaagaagcagaaaaggcaaaaatggaagcagaacgtttagcgaaggaagaggcagaaaaagcaaaaacagaagcggaacgtttagcacaagaaaaagcagaaaaagcgaaagctgaagcagaacgtttggcgaaagaagcagaaaaagcgaaggcggaagcagagcgtttagctaaggaaaaagcagagaaagagaagtcagaagagcaaaaaattattgatgccaaaggtggagttgataataaacagattgggttaagtgaaattcctgttattaaggaagatggtggtaaaaaagagacttacggtagtctctataatcagaaatattctgttgtgaaagctcaaatagttaaaacaggagatgatttaagcaatgttaattcaattgttgaagtaaaaggcttaaatacagaaaaattaccttctgaaggcaaagctacttataatggaaaagcctttgatgctcacggggatgaaggtatttatgcaggtaacttaacttatgaagttaatttttctgagcgtacaggttcaggtcaaataattaatacattggatggtactattgacttggataaaggtaacatagataaaggtttgatttcttccactgcacatcatcgtaagggagagcatactcaaagcggtagatatgaagttcaattttttggacctaatgcagaagaaattggtggtaaagtagatatccaagacgatggaagaacacatagttttggtattagtggaactaaagctaactaa

SEQ ID NO: 898 - protein, 400 aa, M. varigena
MSIKKLTLASLILIGLTACGSSGSGSGSNHKSPEQKITEQKQQLKDKADTAKVEAERLKKQAEKAKEKAESLAKEAEKAKTEAERLAQEKAEKAKAEAERLAKEAEKAKMEAERLAKEKVEKAKTEAERLAQEKAEKAKAEAERLAKEAEKAKMEAERLAKEEAEKAKTEAERLAQEKAEKAKAEAERLAKEAEKAKAEAERLAKEKAEKEKSEEQKIIDAKGGVDNKQIGLSEIPVIKEDGGKKETYGSLYNQKYSVVKAQIVKTGDDLSNVNSIVEVKGLNTEKLPSEGKATYNGKAFDAHGDEGIYAGNLTYEVNFSERTGSGQIINTLDGTIDLDKGNIDKGLISSTAHHRKGEHTQSGRYEVQFFGPNAEEIGGKVDIQDDGRTHSFGISGTKAN

SEQ ID NO: 899 - DNA, 1344 bp, M. viscosa
atgaaagcaagtttgaaatggatattgatatcttttgctatccccgcgctagcagcatgtaagagcggaggagtaaattcaaccaaagacgttgctgcaactaaaaatcaagtacctatcgcggtacccggacaaaatcaaaacgtcgcttttggttccctagtcaaacttgatggcaaaaacagcacggataaagacaaacaactcttaacctataaatggtcgttaaataccaaacctactggctccacagctacgttaagcgctaccgatgccgtttcacctgaatttacaccagacaaagcaggatcttatgtgatcagcttagtcgttaatgatggtaaaattgatagcaaaagtgttgacgtgactattgaagtcgcaccgaaagcagtgaactcgttaccgatggttagcgcaggaatagacaaaacccatgcgattggcacccccgtgttaattgccgcaaccgtaaccgacgctgacaatgatgccttaacttacacttggtctattgaaaccaaggctgctaatagcatgccaacacttacaaatagcgatacaaaaaccgtcacgttaaatgcaaatgtccaaggtgattacctacttcaactgtccgtatcagatggtaaaaacacggtcaaagatagtgtaaaagtaactctagagtcagcaaacgtcgcaccaatagcaaaagcaggggcggatcaaaacgcagttaaagatgcagttgtaaatcttgatggtagtggcagctctgatgccaataatgacgttatgttgtatgaatggacatttgtttccaaacctgagcatagtgtggcagatcttagcggtacgaataccatcacacctagttttacagcggacttaattggcgattatgtattgtctttaacggtgagtgacggtgcattaacgagcgcaccatcgaacatcaaggtgacagtaacagaatcgctcaaaagcgaattaaaaatagtattccacgatagagaccctgctcaaaatacccttccttatgtatttaatccgataacaatagataaaacattctcagaccctaaaccagctacttacaaactagcgagctttacacttgaagcggtaggacaggattacaccataaaagaagtaacaccatggggaattatgggtgtcgtcacccctattataaatggggtggtagaaggtcaagtcattaaagcgggagaaaaggtagaaattgaactactgtctcctctaacaggtggcaaacaagccatgctttcatttagcgtcatcattaaagaaaatatgggcgataactatattaatgcaagttattttctaaccacacactaa

SEQ ID NO: 900 - protein, 447 aa, M. viscosa
MKASLKWILISFAIPALAACKSGGVNSTKDVAATKNQVPIAVPGQNQNVAFGSLVKLDGKNSTDKDKQLLTYKWSLNTKPTGSTATLSATDAVSPEFTPDKAGSYVISLVVNDGKIDSKSVDVTIEVAPKAVNSLPMVSAGIDKTHAIGTPVLIAATVTDADNDALTYTWSIETKAANSMPTLTNSDTKTVTLNANVQGDYLLQLSVSDGKNTVKDSVKVTLESANVAPIAKAGADQNAVKDAVVNLDGSGSSDANNDVMLYEWTFVSKPEHSVADLSGTNTITPSFTADLIGDYVLSLTVSDGALTSAPSNIKVTVTESLKSELKIVFHDRDPAQNTLPYVFNPITIDKTFSDPKPATYKLASFTLEAVGQDYTIKEVTPWGIMGVVTPIINGVVEGQVIKAGEKVEIELLSPLTGGKQAMLSFSVIIKENMGDNYINASYFLTTH

SEQ ID NO: 901 - DNA, 1371 bp, M. viscosa
atgaatgacaaatttaagtggttaacgtgtgttgccactctatccttcttgcttggctgcaacggaggagacgaaagtggaaccaaggataccgggtctagcaaattagaaaatcagtctcctattgctatcgcaggagtaaatcagaatgtaaaagtaaataccaaggttaaattggacggcaccagcagtgttgatgaagataacgacctcatcacttatcaatggaattttgaatccaaaccccaaataagccaagcaacactcattaatagcaacaacgccttatcagaatttacagcggatgctatagggacttatatcattaatttaattgttaatgatggtaaagcaaacagtcgtccaaatcaggttcgaatcgttgttgcgtcttccgggacaaattctcctccgacactcaatttatccagcgaccaaaaactaaatttaatcaataccgcgcatctaaacgccaatgcccgagacgcagacaaggacaaacttttctatctttggcagattatagagcaaccgacggatagcaacccagtattaaatgatgagggtacatccatcagatttaaaacagacattgcaggagactatgtcgtaaaactcacagtgtcagatggactcgctatcgcaacagatacagtaacgctcagctactattatgctaacgtcccccctagcgcaaagacaggcaccgctatctatgcaaccgaaggaatgatagtgccagttgatgcgagtatgagcaatgatccaaatggtgatccgattacgtatcaatgggattttgtctctaaaccgcctaattctaatacggttattgtcgaccctagcgcaatgataagtgagttttacgccgatgcgccgggcacctatgtcgtgggcttaactgtcagtgatggcgagtttaccagcaaaccttacaagccattttatgtgaaagtctacggcttgcaagcaccacataccaagctcttcgttggcaatgatagcaaactgcaactattcccttataaagaaaagtttgtcgtaaataaaacaactgactctggaagtattcccgatgaatacatattaggcaactatacaatagaagcagtgggcaaagatgtaaccattagtggcattaacgctataaactacagtgatgccaagcttaaaccctatttcattggcctatctgaaggtgaaattgtgaccgtaaaaaaaggtgagcgaatgacatttcaactggctacaccgtcgaccaatggtgaaactgtacggttaggttttagtttttcatggagcttaaacggttacggcgactttagttctcaagaaacattctgggctggatatcagttcactagtcgctaa

SEQ ID NO: 902 - protein, 456 aa, M. viscosa
MNDKFKWLTCVATLSFLLGCNGGDESGTKDTGSSKLENQSPIAIAGVNQNVKVNTKVKLDGTSSVDEDNDLITYQWNFESKPQISQATLINSNNALSEFTADAIGTYIINLIVNDGKANSRPNQVRIVVASSGTNSPPTLNLSSDQKLNLINTAHLNANARDADKDKLFYLWQIIEQPTDSNPVLNDEGTSIRFKTDIAGDYVVKLTVSDGLAIATDTVTLSYYYANVPPSAKTGTAIYATEGMIVPVDASMSNDPNGDPITYQWDFVSKPPNSNTVIVDPSAMISEFYADAPGTYVVGLTVSDGEFTSKPYKPFYVKVYGLQAPHTKLFVGNDSKLQLFPYKEKFVVNKTTDSGSIPDEYILGNYTIEAVGKDVTISGINAINYSDAKLKPYFIGLSEGEIVTVKKGERMTFQLATPSTNGETVRLGFSFSWSLNGYGDFSSQETFWAGYQFTSR

SEQ ID NO: 903 - DNA, 747 bp, M. viscosa
atgaaaccagttaaactttcatggattacagcggctatgcttggtcttagctcattagcccacgcaggctttgatggcgcaatcagcgacaattctttacgccaagttggcgagtctcaagtttgggttccgtttttccactcaaaaggcaaagccggcattggcagctcaaaaagtaagaccgttgatttcgatggcctagctggcaacacattctcaagtgattatcgtaacgataacaataacgaaaaaggcgttcacacttcgggcagcaaacattttggtaattctcattacaactttgcgcaagtagccaatagcgatatttggttcggtgagtggtatgaaggaacccaagatcaagacttcaataatcgtaccgtctactacataggtaacgatgctggcacaacggtcccgactagtggcacagcgacgtacaacatcacaggcattaataaattctctggcagcaacaagctgactggtgcctttgatgctgactttggcgcacaaacactgtctggcaacatttctaatggttcactaaaagtgaatgtaacagcgcaaattaatgccgcgacagcagcctttacgggtaacgcaacggcaacacaaaatgccgtagctacggcgggtagttctaaaggtcatttctttggcgcgaatgcagcagcacttgcaggctttgcaaaattcgatactaacagccaactggatactgcattcggtggtgaaaaacagtaa

SEQ ID NO: 904 - protein, 248 aa, M. viscosa
MKPVKLSWITAAMLGLSSLAHAGFDGAISDNSLRQVGESQVWVPFFHSKGKAGIGSSKSKTVDFDGLAGNTFSSDYRNDNNNEKGVHTSGSKHFGNSHYNFAQVANSDIWFGEWYEGTQDQDFNNRTVYYIGNDAGTTVPTSGTATYNITGINKFSGSNKLTGAFDADFGAQTLSGNISNGSLKVNVTAQINAATAAFTGNATATQNAVATAGSSKGHFFGANAAALAGFAKFDTNSQLDTAFGGEKQ

SEQ ID NO: 905 - DNA, 768 bp, Marinomonas sp. MWYL1
atgaaaaagttacaactagtaagcgcaatgtctctcgctcttggcactttagtattctcaggcatggcaagtgcagccgtcgtgggtgaatccagcaatacgaactatgtaaaagtagggacagccaccgtcaatggtggtcctcatacctctggcggcgcaggtattggcgtgaatgctacaggtattgacaagttagtgaactttcaggggttaacagcttacggcgctaaggatgctcaagatgtctacaccttaaacttcccttacactggctctccaaccagccacgataatctcggagtattcaacttcgctcaagtaggtaccagtgatgtatgggtcggtgagtggtcagcctatggcaccagcggcgattcaactcgtaccgtttactatgccggagcaaatgcagacacctctgtgccaacctctggtacggccacctatacagtcgtgggtatcaataactacgacggcacagcagcaagcttgctaaacggtacattaaccgctgactttgctgcggcaacactaacaggcagcatcgcaaacacaaatggttttgctgttaacgtgggtacggccgccattaacagcgacgctagtgtttctggtagcaatgctactgcgactcagtccggttcattagtggcctataatggtgatgtctctgctcagttctacaatggccaagcagatctagcggggcttgttgactttgctggaactgaatacgacaccgcatttggcggctctaaagactaa

SEQ ID NO: 906 - protein, 255 aa, Marinomonas sp. MWYL1
MKKLQLVSAMSLALGTLVFSGMASAAVVGESSNTNYVKVGTATVNGGPHTSGGAGIGVNATGIDKLVNFQGLTAYGAKDAQDVYTLNFPYTGSPTSHDNLGVFNFAQVGTSDVWVGEWSAYGTSGDSTRTVYYAGANADTSVPTSGTATYTVVGINNYDGTAASLLNGTLTADFAAATLTGSIANTNGFAVNVGTAAINSDASVSGSNATATQSGSLVAYNGDVSAQFYNGQADLAGLVDFAGTEYDTAFGGSKD

SEQ ID NO: 907 - DNA, 801 bp, Martelella sp. AD-3
atgacggcgctgatggggacaatggcgctagcggtccttgcaggttgcagcggcggcgggggaggcggggggccgctcgccccgaacgcgctcggctattatggggatgtcgacacctggaacgcggccgtgacgggctcgggatcggcgtcggccaatatccagatgaatggcgacggcacggtcggcgtcgaaatcacaggcgggcccgatacgggcgaaacggcgctcttctatccggacggcgaaggctatacggccaatcttggcgatggcgccgaagcctatatgcgactcggctactttggcgtcgacgggatcaaggacgggcctgtggtcgccctgatcgacgccgacacctgggatgacaacgtcgtggctatggcgtttcgctcgaccgacggcgtgaccgcgccgggcgacatgcccttggcgggccgcgcgacctattccggccagcatctcggcgcggcggcgcttccgggcgagtatctcgactatatcgacggctcgttcaacgccaatgtggatttcggcagtggacaactggccggggcgatggacacccaggtgggcgacgtcaccttccaggcgacgatttccggttcggaattcaactccaatgccaattcgattgccgtcggcaatgattatgtaaatgtcgatcaggcaaactcgaacgtgaacggggccttttacggcaatcgcgctgccggcatcgccggaacctacagggtgaacggcgcgcgggctgatgccggggcgggcatgatcggcacctttgtcggcgaacggaactga

SEQ ID NO: 908 - protein, 266 aa, Martelella sp. AD-3
MTALMGTMALAVLAGCSGGGGGGGPLAPNALGYYGDVDTWNAAVTGSGSASANIQMNGDGTVGVEITGGPDTGETALFYPDGEGYTANLGDGAEAYMRLGYFGVDGIKDGPVVALIDADTWDDNVVAMAFRSTDGVTAPGDMPLAGRATYSGQHLGAAALPGEYLDYIDGSFNANVDFGSGQLAGAMDTQVGDVTFQATISGSEFNSNANSIAVGNDYVNVDQANSNVNGAFYGNRAAGIAGTYRVNGARADAGAGMIGTFVGERN

SEQ ID NO: 909 - DNA, 873 bp, Martelella sp. AD-3
atgaacaagaactttctggctgctctagcaggcaccgcaatgatcgcggtggccggatgcagcagcacgtccggcaacagttcttcgggggatccgggcaatggcggcggcggcgcaccgggaggccaacccggcggcggcgacggcagctacaccgttggcggaaccactgttcaactgaggaacggatccgtcacgacggttgccgatgcgacgggcgactataccgaagatgacaatggcaacatttcggttagcttcacatccggcacctataacggccagagcctgtccttcagcgaggttggcagcacctccgagctgaacggccagacagcgacactggaagcattcctcggttccgaagatgacaacagctcttcgggcgccatgtatatcaccgtggacgatgaaaatgacgaggggaacggcgacttcatcgctctttacagcggcgacaccatatccgatctgccgcaggaaggcactggcacctatcggggcgactatttcggcgaggcgcagaatggcgccgccggcggcctggtgtccggctcgagcgcaatcaccgtcgactttcagaacggcgcggtttcgggtgatttcagcgacctgaccatctatgacggcgacgcgccgatcggcgccatggacgatgttggcttctcgggcactatggacaagaacagcgctgcctatgtggctgacagcgtgacgatcggcggtgatccggccggcgaaggctccagcgtcaagggttcgctttttggcggcggcgcgagttcgacggccggcagtgtggctgcctttgacaatgccgacaatccgaccaaggcaaccatcggcgtgttccaggcgaaccgggcagactga

SEQ ID NO: 910 - protein, 290 aa, Martelella sp. AD-3
MNKNFLAALAGTAMIAVAGCSSTSGNSSSGDPGNGGGGAPGGQPGGGDGSYTVGGTTVQLRNGSVTTVADATGDYTEDDNGNISVSFTSGTYNGQSLSFSEVGSTSELNGQTATLEAFLGSEDDNSSSGAMYITVDDENDEGNGDFIALYSGDTISDLPQEGTGTYRGDYFGEAQNGAAGGLVSGSSAITVDFQNGAVSGDFSDLTIYDGDAPIGAMDDVGFSGTMDKNSAAYVADSVTIGGDPAGEGSSVKGSLFGGGASSTAGSVAAFDNADNPTKATIGVFQANRAD

SEQ ID NO: 911 - DNA, 861 bp, N. aromaticivorans
atgctgctcgcgtcgtgcggtggcggcggtggtggcggcagcgtcggttccacgcccacgccggtctacacctacaagacgctcgaccagttgagcggagaccagaccttccagtcggggggcatcgccggccagccggccagcgatggccgcctcgtccagaccacgaagcctttcggccagggcatcgagatcaagtatttcgccgcgagcgacacctacaacctcaacgacggcgccggcctcgtcgcggaatttgccccggccgacgtgcgcgtggtcgatgaagcggcgggcgcggtccagtaccagaaggtcgtcggcagcgatctcaacgtgctcacgctcatcaatccgcgtctcaacggcgtgccgctcagctataccacgatcggctcgtggctgcacctcagcccctcggctgcggcaacgcgcttctatctgatggtcggcggcgttccgacccaggccggcgacgtcccgcgcagcggcagcgccacctacaccaccgccgtcggcggtggcggcaccttcaatggcacgaactacaacttctccgccaacagcaccggcacgttcagcgccaatttcgccaacaacaccgtcagcacttcggtccatctctccggcctgccgaacggcacgaccgtcgggacgccgttcgatgcgggaacctacaacggcaccggcaacatctcgtccaccggccccggcttcacgggcacgctgaccggcaccgcagccaacggcgcgttctccggtgcgttcttcggtccccgggccaccgagttcggctatgccttctacctcgatggcaccggcacccagatccagggaacgatggtcggcaagaagaactga

SEQ ID NO: 912 - protein, 286 aa, N. aromaticivorans
MLLASCGGGGGGGSVGSTPTPVYTYKTLDQLSGDQTFQSGGIAGQPASDGRLVQTTKPFGQGIEIKYFAASDTYNLNDGAGLVAEFAPADVRVVDEAAGAVQYQKVVGSDLNVLTLINPRLNGVPLSYTTIGSWLHLSPSAAATRFYLMVGGVPTQAGDVPRSGSATYTTAVGGGGTFNGTNYNFSANSTGTFSANFANNTVSTSVHLSGLPNGTTVGTPFDAGTYNGTGNISSTGPGFTGTLTGTAANGAFSGAFFGPRATEFGYAFYLDGTGTQIQGTMVGKKN

SEQ ID NO: 913 - DNA, 1945 bp, N. cinerea
ggaagcacgcaaagctgaagaagcgcgtaaagccgaagaagcccgcaaagctgaagaggcacgtaaagccgaagaagcccgcaagctgaagaagctcgtaaagccgaagaggcacgtaaagccgaagaggcacgtaaagccgaagaagcacgtaaagctgaggaagcgcgtaaagctgaagaggcacgtaaagccgaagaaacgtaaggctgaggaagcacgtaaagctgaagaagctcgtaaagctgaagaagcacgtaaagccgaagaagcacgtaaagccgaagaggcacgtaaagctgaagaagcgcgtattgctgcgcgtaaggctgatttggtgaaaaaagccaccgaagcgggtttgaaccaaaaacaggccgcagcttttgccgagtccaatgtggatacggccgattccgaaattcagacggccttggatgctgcgtttaaagcggcagttgccgaagccaaaggcggcgtgtatgcaaaaggctttgacgagcagaaaaatcaggtttcgcaatcgtcggaatatcgggaagtgctgacaccggcaggcaaaacaacgacatggcagacgacaaccgtttcatccgtgcagaaagcctacaaccaggattattccgtcgtagtcggcaacggtacggttacggaaacaaacgacggctacaacggcacgcagaccgacacgacgtttgccgtcagcaaagtggcgggttacgccacgcctgacaaagccgtgccgaccacaggctctgccgaatatcagggcaaagcattctcgaaagagggcaaaggcgatttgaactacaccgtcaatttcgacaaacgtaccggctcgggcaggattaccgatattgccgaaacaggccgcattgatttggccgaaggcaagcttggcaaagtcagcgtcggagataaaaccgtaaccggtatcagcgcggcggcttccgccgaaaacggctcgaaaggcacataccgcctcggcctgttcggcaaagcggcagaagaaatcgcaggatcggccaagctgccggaaagcgaaatcggcttcggcggcaaacgcggggactttatcagccgcgaagaaaccgaacgcctggaaaaacgcaaagccgagttgaacaaaaacgcaaccgaaggcgggctgactgccgctcaggccaaagactatgccgaaaaacacctgaaacaggacgatgtggcggcgcaggcagcgttaaaagaactggtgaccaaaaaagcctatcaggacggcttggcggcggccaaagaagaaaaagcgaagctggatatttatccggcggtggatgtaaacagctatgcggtggatgctaaacaaacgcatttcgttaatcaaaattttaccaacgtcaatgacgatggcgaagtaaccagatttaaaggatcaagtcagatttaccagcagccgttttccgtcgtactcagccaacgtgttgaggaagacatccgcaacaatcaaaatttgtctcctgagtacagtagaatcagcagttatattgcaggttttgccacccctgagaatgccctgccgaccatcggaacagccgtttacaagggtttggctttaaaaacaccgtacgagggagtttttacttataaagtcaatttcgacaaacgtactggctcgggttcgattgcgggggttgaatatgcaaaaatgatttcccttgccgaaggaaatatcggtaaagtgaatatgcagggcaaagagataattgggatcaatggcactgcggatgtaacttcaaaatcagtattatatgaattaaccaacggttcgtacaccttgggtttcttcggttcggctgcacaagaagtggcaggtactgtccgatttgattctgacctcaaaagtggtctcaccaaggacggaaaatttgaaatcggctttggcggccagcgtggcgaaatcaaaaaataa

SEQ ID NO: 914 - protein, 647 aa, N. cinerea
EARKAEEARKAEEARKAEEARKAEEARKLKKLVKPKRHVKPKRHVKPKKHVKLRKRVKLKRHVKPKKRKAEEARKAEEARKAEEARKAEEARKAEEARKAEEARIAARKADLVKKATEAGLNQKQAAAFAESNVDTADSEIQTALDAAFKAAVAEAKGGVYAKGFDEQKNQVSQSSEYREVLTPAGKTTTWQTTTVSSVQKAYNQDYSVVVGNGTVTETNDGYNGTQTDTTFAVSKVAGYATPDKAVPTTGSAEYQGKAFSKEGKGDLNYTVNFDKRTGSGRITDIAETGRIDLAEGKLGKVSVGDKTVTGISAAASAENGSKGTYRLGLFGKAAEEIAGSAKLPESEIGFGGKRGDFISREETERLEKRKAELNKNATEGGLTAAQAKDYAEKHLKQDDVAAQAALKELVTKKAYQDGLAAAKEEKAKLDIYPAVDVNSYAVDAKQTHFVNQNFTNVNDDGEVTRFKGSSQIYQQPFSVVLSQRVEEDIRNNQNLSPEYSRISSYIAGFATPENALPTIGTAVYKGLALKTPYEGVFTYKVNFDKRTGSGSIAGVEYAKMISLAEGNIGKVNMQGKEIIGINGTADVTSKSVLYELTNGSYTLGFFGSAAQEVAGTVRFDSDLKSGLTKDGKFEIGFGGQRGEIKK

SEQ ID NO: 915 - DNA, 963 bp, N. cinerea
atgtctatcttcaaaaaaaccctgttggccgccgtactgtgcggcgttttcggcgtggcggcagcagaacccggtatcaaagattacggcggttcttccgaacttaagaatgtagagcctggccaatcgggtgtcatccccttcggtgcgggcaaggccggtttgcgctttgtaaacggcggcaattggtcggcctccatcaacctgcaaaacggtccggtacagcatatccgcaacaaatataacgacggcaaaaatccgattaacggtactgatccgtatgccaacgttgatggcacacgtaattcgcaatatctgatgttgcgcgatgtcgccccggtaatcggctggttctacaatccgaaattaggtcaggtgtggtatgaaaaccgccacaacaacaccgaagtgtacagcgtacgccaaataaccgaaccgaaactcttctttgcacccaagttcagcggcctggtaatcgccaaagtgccgggtatgagtgaaggcaacaacgtgttcttcggcgaatgggcaccacgtgccggcaacccgccgaaaaacagcaccgacctgaatatggcggacggcaaacgcaccgtttggtatgtgggcgacaatccgacccaaaatatgccggtactgtccgaagccacttataacgtgctgggtgtgaataagcataccccgggtcagaacgacttctataccggcgtgctgaccgccaactatggcgcgggtaaaaacaccttggaaggcagcttgtcccgccctggcgatagcgtgaaatttgacggtaccaatattcggagcaacggtacgtttgacaacggtaaggctgacgaacgcattaccggtcgcttctacggcagcggcgcggaggctctggccggtattgtggatcgggatggccaagccggagtagatagggatattgccttcggtggtaagaaaatcccgccgcaataa

SEQ ID NO: 916 - protein, 320 aa, N. cinerea
MSIFKKTLLAAVLCGVFGVAAAEPGIKDYGGSSELKNVEPGQSGVIPFGAGKAGLRFVNGGNWSASINLQNGPVQHIRNKYNDGKNPINGTDPYANVDGTRNSQYLMLRDVAPVIGWFYNPKLGQVWYENRHNNTEVYSVRQITEPKLFFAPKFSGLVIAKVPGMSEGNNVFFGEWAPRAGNPPKNSTDLNMADGKRTVWYVGDNPTQNMPVLSEATYNVLGVNKHTPGQNDFYTGVLTANYGAGKNTLEGSLSRPGDSVKFDGTNIRSNGTFDNGKADERITGRFYGSGAEALAGIVDRDGQAGVDRDIAFGGKKIPPQ

SEQ ID NO: 917 - DNA, 993 bp, N. cinerea
atgaaaatcaacatatccgcaatttctgcggccacctctctgattctgactgcctgtgcaggaggaggtgcatccgagccgaaagttcccgtttccataccaacggcgcagcccatcgctaatatcaagttgagcgatgaaagcagtgcaataaaaaccatcaacaccctttccggaaaaggcggcagcttgcatgaagcagaactcgaagtgaaaacatcatggggcagctataccgataaacaatatgtctaccaaaccccttccggcaactattacaacatcagctcatattccgacccaattgtcccttcctactcaagcccatcctatgtagtccgtacccgccacgaaggtcagcctttatccgaaggcggcaagctgtttgtctgctgcagcagttccggacaatttactgatgccccagcaaccaaacaggaccacctcaaattcggcgcatggataaatgcagacggcacggcagacctgtttgtcggtggcaaacccgtcggaacggcaaaaccgtcttattacactccgtctgacagtactgtggcaaaaggcaagactacatacgaagtttgggcagtacgcgtacgcaacggcaatttcgttacctctacctacgagcccaaaaacccctataagtcgtctgaaaagaccgctcccaagctttcactgctgacagccaatttcaacaccaacaaactcggcggcacgattttaggtaatgcggattacggtccggacgttgtgatgaaagatgtaggcatcaacggcgttgatttctcaggcactgccgaatcagacggtaaaaacggcaaagtcgaaggaaaattcttcggtcaatttgacggcgataaaacagaagtcaacataggcggcaaagtaaccttcgatgccgataaatcgttggataccgtattcggcggcgtgaagaatgatgacgaccgcaatacgacggatacaagtttgacacctgtcagcaagtaa

SEQ ID NO: 918 - protein, 330 aa, N. cinerea
MKINISAISAATSLILTACAGGGASEPKVPVSIPTAQPIANIKLSDESSAIKTINTLSGKGGSLHEAELEVKTSWGSYTDKQYVYQTPSGNYYNISSYSDPIVPSYSSPSYVVRTRHEGQPLSEGGKLFVCCSSSGQFTDAPATKQDHLKFGAWINADGTADLFVGGKPVGTAKPSYYTPSDSTVAKGKTTYEVWAVRVRNGNFVTSTYEPKNPYKSSEKTAPKLSLLTANFNTNKLGGTILGNADYGPDVVMKDVGINGVDFSGTAESDGKNGKVEGKFFGQFDGDKTEVNIGGKVTFDADKSLDTVFGGVKNDDDRNTTDTSLTPVSK

SEQ ID NO: 919 - DNA, 1740 bp, N. flavescens
atgcatcttccctttaaattcagaccgggtttggcggcaattgcctgcatttttgccctttctgcctgtgcttcaggcggtggtaagtcgcccgatgttcatcccacagagacattaaataaagttactccttcacccactgataaaggcagccattctgaaattgtcgatggcaaggatcaggatgctgccacgcctgcacaacctgtagacaaacaggatacaggtacacatgctggttctgattcaggtacacagggagatacacccaagaataacaatccgcaagccggacagggtgaaactgctagaagtgttacggatggcaaggatcagggtgccgccacgcctgcacaacctgtagataagcaggatacaggtgagcaaggtagttctgatgcaggcgtgtcagtgttgaagccaaataattcgaccccgattgttcctacaacttctgagaaattagaccaggcaattaaagcaattgaaaatactgataaagagattgccgataaagaaaaacaagcagaagaaaaagaggcaatcatttcatctttggacaactcagggtctcctccggctgatcttatcaaaggggctcgagaatataccaatagtaagagagatctgcaaaacacacatgaggcaaaggtagcaaaagagaagcagcaaatcaaacagcttgaagatgcagttaaattgctagagctgaggaaggctgaagtccaatcttctgcagatcaagccgatttggaaagtaaaaaagctgaattagagaaacaaataagcgagcagaaagtaaagcttgcatcatcggagcaaaaattagaagaagttaaaacggatgtccaacgacttgaaaaatttacggaatatttaggaaattcatcattaaaagaggttaaacccgaattgagccaacgggtatgggaaagtaaactaagggaatttaaaaatctcggatcatatgaaaaaaaatttgaaactgccgcattgtttaaagcatacttgattagtgaaaatcaagataaacaagataccgcattcactgaggaaaaagtccgggatatggatgtgtatatcaatggagaaaaatacgaaggtaaagacggtgatgaatatgctgttaaaccgcttggcttgcagtcgcagactgtagaaatttatgggcaagataaagatcaaaattatcattcagaaaaatcttgggtttatgagcagccgtattctgttgtggcaggatattttacccaaacgatacaaaacggtaagaaggatgaggatggagcagacaaacttgacattggattgagtgatatacaaggcttggcaacagaagaagcacaattaccgaaggtaggcgctttcgattatgaaggcaaggcattcggcggttcttcggctaagcctgatagcaagttggaagaacatcaaggtgaattcaagtaccgtatcgactttgacaaacgtaaaggttcgggctcaattgaaggtttgtctgaatatggccgtattgatttaaaagaagctgatattgtaaaaggtaataatttgaagtatgtcaacaaaccttattacgggatagacaatggcgaagcagcttcggaacgtggcgggcttaaatattattccttaggtattttcgggccggaggccaatgaggtgacgggtgtagtcggtacgtccggagaccaagataaacttgccagggatgtcggcttcggcggtcaaaaaaagtag

SEQ ID NO: 920 - protein, 579 aa, N. flavescens
MHLPFKFRPGLAAIACIFALSACASGGGKSPDVHPTETLNKVTPSPTDKGSHSEIVDGKDQDAATPAQPVDKQDTGTHAGSDSGTQGDTPKNNNPQAGQGETARSVTDGKDQGAATPAQPVDKQDTGEQGSSDAGVSVLKPNNSTPIVPTTSEKLDQAIKAIENTDKEIADKEKQAEEKEAIISSLDNSGSPPADLIKGAREYTNSKRDLQNTHEAKVAKEKQQIKQLEDAVKLLELRKAEVQSSADQADLESKKAELEKQISEQKVKLASSEQKLEEVKTDVQRLEKFTEYLGNSSLKEVKPELSQRVWESKLREFKNLGSYEKKFETAALFKAYLISENQDKQDTAFTEEKVRDMDVYINGEKYEGKDGDEYAVKPLGLQSQTVEIYGQDKDQNYHSEKSWVYEQPYSVVAGYFTQTIQNGKKDEDGADKLDIGLSDIQGLATEEAQLPKVGAFDYEGKAFGGSSAKPDSKLEEHQGEFKYRIDFDKRKGSGSIEGLSEYGRIDLKEADIVKGNNLKYVNKPYYGIDNGEAASERGGLKYYSLGIFGPEANEVTGVVGTSGDQDKLARDVGFGGQKK

SEQ ID NO: 921 - DNA, 996 bp, N. flavescens
atgaaaattaatgtatttatagtgcctattgcaactgcctttattttgactgcatgtgcaggtggaggtgcatctgaacccaaagtccccgttgctattccgacagctcaacctatcgccaatgttaagctgagcgatgaaaacagtgcggtacagaccatcaataccctttccggaaaaggcggcagcctgcgtgaagcggaagtcgaagtgacaacatcatggggctacagctatcccgagaagcaatatgtctatcaaaccccttcaggcaactattacaacatcagctcatattccgatccgattgtccccgactctttcagcccgtcttatgccctgcgtacccgccacgaaggccagcctttatctgaaggcggcaagctgtttgtctgttgcagtagttctgggcagttcacctatgccccggcaaccaaacaggaccacctcaaattcggcgcatggataaatgcagacggcacagcatacctgtttgtcggcggcaaacccgtcggaacggcgaaaccgtcttattacactccgtcagacagtaaagaggcaaaaggcaagaccacatacgaagtttgggcggttcgcgtccgcaacggcaatatcgttacctctacctacgagcccaaaaaatcctctgtgttgtctgaaaaaactgctcccaagctttcactgctgacagccaatttcaacacccacaaactcggcggcacgatcttgggtaatgcggattacggtccggatgttgtgatgaaagatgttggcatcagcggcgttaatttctcgggcactgccacctccaatggcaaaaccggcacagttgaaggaaaattcttcggtcagtttaacgctgatcaatctgaagtcagcataggcggcaaagtaaccttcgatgccgataaatcgttggataccgtattcggcggcgtgaaaaattcatcaaaccgcgatacgcaagatacaagcttggaacctgtcagccagtaa

SEQ ID NO: 922 - protein, 331 aa, N. flavescens
MKINVFIVPIATAFILTACAGGGASEPKVPVAIPTAQPIANVKLSDENSAVQTINTLSGKGGSLREAEVEVTTSWGYSYPEKQYVYQTPSGNYYNISSYSDPIVPDSFSPSYALRTRHEGQPLSEGGKLFVCCSSSGQFTYAPATKQDHLKFGAWINADGTAYLFVGGKPVGTAKPSYYTPSDSKEAKGKTTYEVWAVRVRNGNIVTSTYEPKKSSVLSEKTAPKLSLLTANFNTHKLGGTILGNADYGPDVVMKDVGISGVNFSGTATSNGKTGTVEGKFFGQFNADQSEVSIGGKVTFDADKSLDTVFGGVKNSSNRDTQDTSLEPVSQ

SEQ ID NO: 923 - DNA, 1361 bp, N. gonorrhoeae
gcaggcacgtccgatttccgcgccgccccataaaacagttgacatcatataacatttaaattgataatcaaaactattattaatacatcatcaagattgagtatgcgatgaaatacaaagccctgcccttactgccgcttgccgccgcccttgccgcctgtgccggggggggggtagccgaaccgcacgtccccgtgtccatccccaccgccacgccgctgcccgccggcgaggtaacgttatcaagcgataacggcaatatcgaaaacatcaacaccgccggcgccggaagcgcatccgacgcgccgagccgcagcagacgctcgctcgatgccgccccgcaaaacacatccggcatttccattcggcagcgggaagtagaaaaagactatttcggctataaatcaaaagaaacatcattcatcttcaaaacacccggcggcgcgcaatacgccctttcatcctacgccgaccccataaccgtcagctactcctcccccgatttcaaaattcccgaccgccacgcagggcagcggctcgccgacggcagccgcatctttatctgctgcagcgactccggggctacttcgtatgcggaaattaccaaacaagattatatgaaattcggggcgtggataggtcctaacggcgaaatcgacctcttcgccggcggcttccccgtcggcaaaacgccgcctcctgcgttctcctacggcagcagcacgcccgaaaccgcattgtcaaagggtaaaatcacttatcaggtttggggcatccgcgtcagaaacgggcaatttgttacttcctcttatacgccgccgaaaagcggttcttattatgggacacttgccaatacccccgtcctttcctttatcaccgccaatttcaacagcaacacactggcaggcaaaatcctcggcaacagcgattacgggccggatgtggatattcaaaacgcaacgattaccggtccgaccttttccggcgatgccacgtccggcgggaaaagcggcaaattggaaggcaagttttttggcaagttcgccagcacccgcagcagcgaagtcagcataggcggcaaaatcacctttgacggcgaccgctccctcgataccgtattcggcggtgtgagttatgaaaaaaaacttgatgacaccagtcaagataccaaccaccttactaaacaataaaccacctcatccctgcaaaggtttcttatgcccattcccttcaaacccgtattggctgccgccgccatcgcccaagcgtttcccgcctttgcggcagaccccgcgccgcagtccgcccaaacgctgaacgaaatcaccgttaccggcacgcacaaaacccaaaaactcggc

SEQ ID NO: 924 - protein, 360 aa, N. gonorrhoeae
MKYKALPLLPLAAALAACAGGGVAEPHVPVSIPTATPLPAGEVTLSSDNGNIENINTAGAGSASDAPSRSRRSLDAAPQNTSGISIRQREVEKDYFGYKSKETSFIFKTPGGAQYALSSYADPITVSYSSPDFKIPDRHAGQRLADGSRIFICCSDSGATSYAEITKQDYMKFGAWIGPNGEIDLFAGGFPVGKTPPPAFSYGSSTPETALSKGKITYQVWGIRVRNGQFVTSSYTPPKSGSYYGTLANTPVLSFITANFNSNTLAGKILGNSDYGPDVDIQNATITGPTFSGDATSGGKSGKLEGKFFGKFASTRSSEVSIGGKITFDGDRSLDTVFGGVSYEKKLDDTSQDTNHLTKQ

SEQ ID NO: 925 - DNA, 1089 bp, N. indicus
atgaagaaaatcagttcaacactggctttgctgctcgtatcggcaagccttgcagcctgttcatccgccaccaccggctctggcggttcgggcggttcccttgggggcggtggttccggcggcagcggtggatccggtggcggatcgggcggcggttcgagcggtggctcgggtgggggtggggccggcagcggcatccagcttttcggtctgaagtcgacctataacaagaagctgcagacctccacgggcgtcggccctgacatctatgaaggcagcgaggtctacgtatccgacgatacggcgagcacgggcgcacagactataacgggttccctcgaactcgatggtggcaagctggtcgacaaggttgacgccacttccacctcgagcgcgggcacggtagtggctgaaaacggcacggtgctgccgcgcgccaacggcacgttgcgtggcgatttcgtgacttcgcaaacgagcgatccggcgacggcgcttgaccaaatgcgcgtcacctcgctcgatttcgatggcgacaatgacgacgatttcttcgtggtcgagcagcatctcggatacggatatttcagcggtaccgaaaccatcaccaccatgtatggcggcaagattgctcctgcctcggcactcgcaggcaagcagacagcggtctatcagcgcactcgcagcgagggcggcgccgagttccagtacaagactggtcccggcttctcccaggagggggccaccttcaccggcgatgccacggtgaacgcgaacttcgacaccggcaaggtcgatgtgctcatcgacaacacccagcgccagcacggcaccaagggaccgtcgcaggtgggtgtcgaactcgccggcgcatcgatcaacggcagccatttctccggcggcacggtgcggatgttcgacgaatccaacggtgccacaatctccaacctttcgccgggcagttccgattattcgggtgccttcttcggcgacaacgccgagcatgtcggtggtgtgttccagggcaacggaaccatcaacggcaatacccccggcatggtgaagggatggttcgccgcaagcgaatga

SEQ ID NO: 926 - protein, 362 aa, N. indicus
MKKISSTLALLLVSASLAACSSATTGSGGSGGSLGGGGSGGSGGSGGGSGGGSSGGSGGGGAGSGIQLFGLKSTYNKKLQTSTGVGPDIYEGSEVYVSDDTASTGAQTITGSLELDGGKLVDKVDATSTSSAGTVVAENGTVLPRANGTLRGDFVTSQTSDPATALDQMRVTSLDFDGDNDDDFFVVEQHLGYGYFSGTETITTMYGGKIAPASALAGKQTAVYQRTRSEGGAEFQYKTGPGFSQEGATFTGDATVNANFDTGKVDVLIDNTQRQHGTKGPSQVGVELAGASINGSHFSGGTVRMFDESNGATISNLSPGSSDYSGAFFGDNAEHVGGVFQGNGTINGNTPGMVKGWFAASE

SEQ ID NO: 927 - DNA, 1023 bp, N. lactamica
atgaaatacaaagccctgtccttactgccgcttgccgccgcccttgccgcctgtgccggggggggggtagccgaaccgcacgtccccgtgtccatccccaccgccacgccgctgcccaaaggcgaggtaacgttatcaagcgataacggcaaaatcgaaaacatcaacaccaccagcaccggaagcacatccggcatttccattcaagagcgggcggttacaaaaaactatttcggtgttgaatcacaagaaaaatcattcatcttcaaaacacccggcggcgcgcaatacaccctttcatcctacgccgaccccataaccgtcagctactcctcccccgatttcaaaattcccgaccgccacgcagggcagcggcttgccgacggcagccgcatctttatctgttgcagcgaatccggggctacttcgtatgcggaaatcaccaaacaagattatatgaaattcggggcgtggataggtcccaacggcgaaatcgacctcttcgccggcggcttccccgtcggcaaaacgccgaaaccggcatactcctggagcgacgacacgcccgaaaccgccggcaagggcaaaatcacttatcaggtttggggcatccgcgtcagaaatgggcaatttgttacttcctcttatacgccgccaaaaagcggttattggggtccacctaccaacacccccgtcctttcctttatcaccgccaatttcaacagcaacaaactggcaggcaaaatcctcggcaacagcgattacgggccggatgtggaaattaaagaagcaacgattaacggtctgaccttttccggcactgccacatccggtgggcaaaccggcaacttggacggcaagttttttggcaagttcgacagtagttacagcagcgacaccagtataggcggcaaaatcacctttgatggcgaccgctccctcgataccgtattcggcggtgtgagttataaaaaagaacttgaaaacaacactgatacaagtaccacccatctcacaaaataa

SEQ ID NO: 928 - protein, 340 aa, N. lactamica
MKYKALSLLPLAAALAACAGGGVAEPHVPVSIPTATPLPKGEVTLSSDNGKIENINTTSTGSTSGISIQERAVTKNYFGVESQEKSFIFKTPGGAQYTLSSYADPITVSYSSPDFKIPDRHAGQRLADGSRIFICCSESGATSYAEITKQDYMKFGAWIGPNGEIDLFAGGFPVGKTPKPAYSWSDDTPETAGKGKITYQVWGIRVRNGQFVTSSYTPPKSGYWGPPTNTPVLSFITANFNSNKLAGKILGNSDYGPDVEIKEATINGLTFSGTATSGGQTGNLDGKFFGKFDSSYSSDTSIGGKITFDGDRSLDTVFGGVSYKKELENNTDTSTTHLTK

SEQ ID NO: 929 - DNA, 1860 bp, N. lactamica
atgaaagtatctcaatcagtaatgaataaacttgttattgctgctattgcctctatggggctaacagcgtgcgcgggtggcggttccggttcatctatgtcggctcaaccaagcgtttcagaatcaccgaaagacaacgcaggcacgggtagcaactccggtcagccaagcgtttcagaaccgccgaaagacaacgcaggcacgggtagcaactccggtcagccaagcgtttcagaaccgccgaaagacaacgcaggcacgggtagcaactccggtcagccaagcgtttcagaatcaccgaaagacaacgcaggcacgggtagcaactccggtcagccaagcgtttcagaaccgccgaaagacaacgcaggcacgggtagcaactccggtcagccaagcgtttcagaatcaccgaaagacaacgcaggcacgggtagcaactccggtcagccaagcgtttcagaatcaccgaaagacaacgcaggcacgggtagcgactccggtcagccaagcgtttcagagccatcgaaagacaacgcaggcacgggtagcgactccggtcaaccaagcgtttcagagccatcgaaagacaacgcaggcacgggtagcgactccggtcaaccaagcgtttcagagccatcgaaagacaacgcaggcacgggtagcgactccggtcaaccaagcgtttcagagccatcgaaagacaacgcaggcacgggtagcgactccggtcaaccaagcgtttcagagccatcgaaagacaacgcaggcacgggtagcgactccggtcaaccaagcgtttcagagccatcgaaagacaacgcaggcacgggtagcgactccggtcaaccaagcgtttcagagccatcgaaagacaacgcaggcacgggtagcaactccggtcagccaagcgtttcagaacaactgaaagacaatgcaaatgttgatacgaaagatgaaaaagttattgaatatctggagaaatcatcattaaaagatgtaccaaaagaattgcaagccaaagtattagaggttaaaggtgatgaatatacaggagcgcgaaaacaatatgcaggtaagctcggtaagggtgaatccgtcaaagcaatgctatttctagacggcgaagagccgtttagtaaggaacaacttcagaagatggatgtgtatgttaatggtaaaaaatacgaaggtagtaaggggggtgagctagatgttctccccaaaggtttgagtgagcaaaagattgagttttacggtgcggataaagaacagaattatgcgctattaaaaacttgggtttatgagcaaccgtattctgtggttagaggctattttggttacactcgaaaagacggtaatcctacagaagagaatagacaaaatcctgaagagattccatttgacttgtctctgggcgacattagaggcgtggcaacagatgaagacaaattacccaaggctgggagctttcaatatgaagggcgggcatttggcggtaatggggttttatccaaagaatcgttagataaccataatggcgtatttagatacacaattgattttgatcttagaaaaggctctggctcaattgaaggaatggaacaatatggcaagatcaaattagaagaagctgctattgagagaatcccttatggagagaacggctccagcttggggttgaaagaccgggtttcttatttcggcgtgaacgaaggggtggctacgtcagagaaggataatgagattaaaaagtatcatttgggtattttcggcgaagcggctaatgaagtagcaggtgctgtaagccaagagcataaatatcaagctgttatcggtttcggcggcgagaagaaatag

SEQ ID NO: 930 - protein, 619 aa, N. lactamica
MKVSQSVMNKLVIAAIASMGLTACAGGGSGSSMSAQPSVSESPKDNAGTGSNSGQPSVSEPPKDNAGTGSNSGQPSVSEPPKDNAGTGSNSGQPSVSESPKDNAGTGSNSGQPSVSEPPKDNAGTGSNSGQPSVSESPKDNAGTGSNSGQPSVSESPKDNAGTGSDSGQPSVSEPSKDNAGTGSDSGQPSVSEPSKDNAGTGSDSGQPSVSEPSKDNAGTGSDSGQPSVSEPSKDNAGTGSDSGQPSVSEPSKDNAGTGSDSGQPSVSEPSKDNAGTGSDSGQPSVSEPSKDNAGTGSNSGQPSVSEQLKDNANVDTKDEKVIEYLEKSSLKDVPKELQAKVLEVKGDEYTGARKQYAGKLGKGESVKAMLFLDGEEPFSKEQLQKMDVYVNGKKYEGSKGGELDVLPKGLSEQKIEFYGADKEQNYALLKTWVYEQPYSVVRGYFGYTRKDGNPTEENRQNPEEIPFDLSLGDIRGVATDEDKLPKAGSFQYEGRAFGGNGVLSKESLDNHNGVFRYTIDFDLRKGSGSIEGMEQYGKIKLEEAAIERIPYGENGSSLGLKDRVSYFGVNEGVATSEKDNEIKKYHLGIFGEAANEVAGAVSQEHKYQAVIGFGGEKK

SEQ ID NO: 931 - DNA, 1026 bp, N. meningitidis
atgaaatacaaagccctgtccttactgccgcttgtcgctgcccttgccgcctgtgccggggggggggtagccgaaccgcacgtccccgtgtccatccccaccgccaccccgctgcccaccggcgaggtaaagttatcagacgacaatagcaaaatcgaaaacatcaacaccgccgacaccggaagcacatccggcatttccattcagcagcggaaatatgaagtagaaagttacggcatcaaaagagaagaaaaagcattcatcttccaaacacccggcggcgcgcaatacgccctttcatcctacgccgaccccataaccgtcagctactcctcccccgatttcaaaattcccgaccgccacgcagggcagcggcttgccgacggcagccgcatctttatctgttgcagcgaatccggggctacttcgtatgcggaaatcaccaaacaagattatatgaaattcggggcgtggataggtcccaacggcgaaatcgacctcttcgccggcggcttccccgtcggcaaaacgccgaagcctaaatactcttggggcaacaccgaacccgaaaccaaaggcaagggcaaaatcacttatcaggtttggggcatccgcgtcagaaacaggcaatttgttacttcctcttatacgccgccgaaaagcggttcttattatgggacacttgccaacacccccgtcctttcctttatcactgccaatttcaacagcaacaaactggcaggcgaaatccgcggcaacagcgattacggaccgagtgtgaaaattgaaaacgcaacgattaacagtttatccttttccggcactgccacgtccggcgggaaaaccggcaatttggaaggcaagttttttggaaaattcaacggctaccgggacactgaaaccagcataggcggcaaaatcacctttgacggcgaccgctccctcgataccgtattcggcggtgtgagttataaaaaagaacttgaaaacaacactgatacaagtaccacccatctcacaaaataa

SEQ ID NO: 932 - protein, 341 aa, N. meningitidis
MKYKALSLLPLVAALAACAGGGVAEPHVPVSIPTATPLPTGEVKLSDDNSKIENINTADTGSTSGISIQQRKYEVESYGIKREEKAFIFQTPGGAQYALSSYADPITVSYSSPDFKIPDRHAGQRLADGSRIFICCSESGATSYAEITKQDYMKFGAWIGPNGEIDLFAGGFPVGKTPKPKYSWGNTEPETKGKGKITYQVWGIRVRNRQFVTSSYTPPKSGSYYGTLANTPVLSFITANFNSNKLAGEIRGNSDYGPSVKIENATINSLSFSGTATSGGKTGNLEGKFFGKFNGYRDTETSIGGKITFDGDRSLDTVFGGVSYKKELENNTDTSTTHLTK

SEQ ID NO: 933 - DNA, 870 bp, N. mucosa
gtgaccaatccgtccaacggcagccaaacaaataacggcaatgccgctgctgccaacaatcaaaataatcccgccagtaatggcaatactgttgcaaacaacgggaataaccctaccaatagcggtaacactgctatcaataatccgctgccacgtgttgatttttcggtttcatacggcgggttgaaaaccaatgcaatcaaggatattcaaaaattagctaaagatttgggagcaccaggggcaaccgttaaatcatacaatgtaacactgggcaatcaatccagcagcggcagcgatcttaagttatccgaatacccgctcaaaaaattagcactcaatcaagactaccgagaaaccgccattgcgcgtgccgaaggtaacgattacaccgttacccgaagcggtaaagcccatatctaccgtcaaaactattctttgattgcaggtatcaatccgactaatacaacagttagaggatcaggagtcaatgaatcagaaaaacttgacgatacttatatcctgattaaaggccaaactacccaaaccctgccgactgcgggcaaatttgactactcaggtattgcaagcgatggcgcaagcaaaggcaaattagcttattctgttgacttcgacaacagaaaaggcagcggtaaaattaccggtgtcggcagcgacatcaatctgaatgaagcgtctatccgggaaggcagctacaccaacgaaatcgataacaccgaaattaagggatacggtattcaaggctcttccaaccgtggcaattatgctctcggcttcttcggtccgaatgcggaagaaatcgtcggtacggtcaatgacggtgaaatcggttttgccggctcccgctaa

SEQ ID NO: 934 - protein, 289 aa, N. mucosa
MTNPSNGSQTNNGNAAAANNQNNPASNGNTVANNGNNPTNSGNTAINNPLPRVDFSVSYGGLKTNAIKDIQKLAKDLGAPGATVKSYNVTLGNQSSSGSDLKLSEYPLKKLALNQDYRETAIARAEGNDYTVTRSGKAHIYRQNYSLIAGINPTNTTVRGSGVNESEKLDDTYILIKGQTTQTLPTAGKFDYSGIASDGASKGKLAYSVDFDNRKGSGKITGVGSDINLNEASIREGSYTNEIDNTEIKGYGIQGSSNRGNYALGFFGPNAEEIVGTVNDGEIGFAGSR

SEQ ID NO: 935 - DNA, 996 bp, N. mucosa
atgaaaatcaaagtacccgcgatttctgcggcagcgacccttattctaactgcctgcgctggaggaggcgcatccgaacccaaagtccccgttgccatacctacggcgcagcctatcgccaatgtcaagctgagtgatgagagcaatgcaataaagaccatcaacaccctttccggtaaaggcggcagcctgcatgaagcggagctcgaagttaaaacatcatggggcagctataccgataaacaatatatctatcaaaccccatccggcaactattacaacatcagctcatattccgacccgattatcccctcctactccagcccgtcttatgccctgcgtactcgccacgaaggccagcctttgtctgaaggtggaaaactatttgtctgttgcagcaattccggacaattcagctatgcccctgcaaccaaacatgatcaccttaaatttggcgcatggataagttcagacggtacggcagacctgtttgtcggcggcaaacctgtcggatcggcaaaaccgtcatggagtacaccgtcagacagtactgtggcaaaaggtaagactacatacgaagtttgggcagtacgcgtccgcaacggcaatatcgttacctcaacctacgatccgggtaaatcctctgggtcgtctgaaaaaaacacgcccaaactttcactgctgacagccaatttcaacaccaacaaactcggcggcacaatcttgggtaatgcggattacggtccggatgttgtgatgaaagatgttggcatcaacggcgttgatttctcgggcactgccgaatccgacggcaaaaacggcaaagtcgaagggaaattcttcggtcagttcaatggcggttataaaacagaagtcagcataggcggcaaagtaacttttgatgccgataaatcgttggataccgtattcggcggcgtagaaaatttatcagaccgcaatacgacagatacaagcttgacacctgtcagccagtaa

SEQ ID NO: 936 - protein, 331 aa, N. mucosa
MKIKVPAISAAATLILTACAGGGASEPKVPVAIPTAQPIANVKLSDESNAIKTINTLSGKGGSLHEAELEVKTSWGSYTDKQYIYQTPSGNYYNISSYSDPIIPSYSSPSYALRTRHEGQPLSEGGKLFVCCSNSGQFSYAPATKHDHLKFGAWISSDGTADLFVGGKPVGSAKPSWSTPSDSTVAKGKTTYEVWAVRVRNGNIVTSTYDPGKSSGSSEKNTPKLSLLTANFNTNKLGGTILGNADYGPDVVMKDVGINGVDFSGTAESDGKNGKVEGKFFGQFNGGYKTEVSIGGKVTFDADKSLDTVFGGVENLSDRNTTDTSLTPVSQ

SEQ ID NO: 937 - DNA, 3393 bp, N. nitratireducens
atgaaatccgttcgcaatttcaagaaaaaaacaattgtattgtctattatgctcggtattgcgttttgtggtaacgcatatggtggtagtggtgttgaggctgggatcaatgttgcattaaacggcattaaaggctatcaacagtatggcgatgaagaaaaattaaaatcagccatttcgggagtcgcttctatcgcaagttcgattgaacttagcgccaactttgtcactgtttcagccgagaaaattaagacattgactgagagtttggcgggtggtacccagcttaatctttttgaacatactcgccatggagctacgttagagttggctgataaagtggggcgttatgcgaatgccttgtctgttgcgactagtgctgctagcgctagtgttgatattcacgactttgcaaagtcagaaaagactcttgttgattcaatgactctattcaaaaatctatctgtcacagctacttcacatgtgccgctgttaggtactggggttgtgattgtggatatgtcaacggatgctttggttgctcaaattaattctttattcgatgccggaagagaggcgagcgtatcggaagcgaattactatcgaaccttgcatgaacttgcttatgcaaaaattgatgccgcaatcatccaaagtattagcaatggaatagatgttgataatgataagatagtcgaaattcaaaaaatggttggcaatgaaatagcaaatattctagatggcattaaacctaaaaatagatttttcgatggtgatgttgctgttaataactataataggttgagggagttgagtgatagattaataagagctgagttctccgatggttttttaaatggaagggttaagcgattcacggcaacgatcaatgaaataagaatcgccgagaaagaatttgttgctgccatgaacagtttgatgtcagatattgacttaattgccgagttggatcaaccattgcagtccttaagaaattccctgcatgaaagagaaaaactgcactcaattgatcatagtaaattcagtgaaaaagccatcagtgacgccatcagcaacaagacggttgatgtaacaagaaccatcgaaaccacccgaaaactcgaactggatcgccagctggcccgtttcgatgtggacatcttcttccttgctgacaacacaggcagcatgggggggttggttggtagcgccaaaacaaatgcacaggctattctggatgccttgcgcaccgatgcgcggttttccaaggtcaacgcgcagtttggggtcggcatgttcttgggcgatccaagtgaatggggcgaaactgcaacgtccgcctaccagctgctacagccgattaccaacaacgatgcccagattacgacggcaatcaatcagtggtatgcatctggtggtggagattgggaagaggccaatttctacgcgattcatcaggtcatcacccagggcgcggctgtgccacgcgacgctacgttgaaaagtaatcaagtaactggctggcgccctggggccgccaaagtgatcgttgtgtttggtgatgccccctcgtggcagaatagcgtcaacgagaaagagctgaaagacttggtccgtacaactggcgcgcgcattgtgtttatcgataccagccagatcaatgtcggtcagcagtcgaacgtattcgcagcatccagcggtaggcaaatgcaggatgccgctctggaaattgctgatgcatctggtggctcatacatgcatctttcagatgtctccaagatcaaggaggctgtgcttgactcggtatatgacgcgattgcagataataattggggcggtggcatgctggcacgaattgatgccggaacaacctggcgctctcgtacgccaagcagcgtaacggcggaaagcaccgatggtggaaagaccttggtctttaccttgcgttacccaaatcagccgaatgcaaccttctcggtagacacttcggttgctggcaaggtttatggacatgagtactatcagggcgcgatcaccggtgccaccaacattttcagcaagaacatgaataccgattcggtgtttcatatcaatgcggcacaagactttttccgttttgttttgcgaggtgaatctggggttgtcgaaggctatttcggcgaacgcctcagtgcgacaaccaaactgccgacctctggcgtttctacttacgatctgcggcatcgtgtcatttctccctatgacaataatgcttacgctgccggaggtatgaaacttttcgtaaactggacgtctggaaaggtgtatggctttgaaagtaacgcctccctggctggcggcacaggcaccgcgctgtttattggtgatattgacagaagtggtcttgagatcgatgggcagtacgtattcaagacccgtcgcctgacgacagccgaaaacagcagcattccccgctacatccgcgatgccatgcgcgaaaccacttcgcttcagttctacggcagcgcctatcccaacgggcttggcgggacttttggttcgacgttttataacgaggccggctcccccacgctgagttcgatgttgatgagcggctacgtcaacgagaaaaccgtgacaaaaccctattccccggcaaacaacgaggtatggagtggctatgccgttggtttggtggccaatcgcagcacgggtgcggttgctgtcgcttacaacacgaatcccaatgatgtgcagatgaccttgcgacctgtctcagcaactgccaaggcagacatcacggtgcgcgatggtgggacggcgtacaacttcggtagcgattggtcggataccagcgtttatatcaacaaggatgcgtttgctgcgatcaaggaaattaatggcgttccctcctacgccgccacgaccatgaccgaggacgatggctacaactacctgtcttggggcgtgtggagcaccgagctggttgccacacccaatacgtcggtcatggatggctcgcactggattgcaggcaccttgacgccaacaacttccatgccggtaacaggctccgcgacctatacgggtcagattcgtggtaccgcacatgagggcggtgcattgcatgcgctcaatggaagcaccaacctgaccgcgaacttcggtaccggcaatatttctggacaactgaatgttcaatatgccaatacgggagccgcatatgccacctccaatctgagcggcgtgacgatcagcggaaaccagttcggcggaagcttgagcggatcgaataacgctggggcaattcagggtggattctttgggcctgctgctcaggaggttgggggtaactgggcgatagagaagacttcaggttcgaaagctgcgggggtgttttctggcaagagataa

SEQ ID NO: 938 - protein, 1130 aa, N. nitratireducens
MKSVRNFKKKTIVLSIMLGIAFCGNAYGGSGVEAGINVALNGIKGYQQYGDEEKLKSAISGVASIASSIELSANFVTVSAEKIKTLTESLAGGTQLNLFEHTRHGATLELADKVGRYANALSVATSAASASVDIHDFAKSEKTLVDSMTLFKNLSVTATSHVPLLGTGVVIVDMSTDALVAQINSLFDAGREASVSEANYYRTLHELAYAKIDAAIIQSISNGIDVDNDKIVEIQKMVGNEIANILDGIKPKNRFFDGDVAVNNYNRLRELSDRLIRAEFSDGFLNGRVKRFTATINEIRIAEKEFVAAMNSLMSDIDLIAELDQPLQSLRNSLHEREKLHSIDHSKFSEKAISDAISNKTVDVTRTIETTRKLELDRQLARFDVDIFFLADNTGSMGGLVGSAKTNAQAILDALRTDARFSKVNAQFGVGMFLGDPSEWGETATSAYQLLQPITNNDAQITTAINQWYASGGGDWEEANFYAIHQVITQGAAVPRDATLKSNQVTGWRPGAAKVIVVFGDAPSWQNSVNEKELKDLVRTTGARIVFIDTSQINVGQQSNVFAASSGRQMQDAALEIADASGGSYMHLSDVSKIKEAVLDSVYDAIADNNWGGGMLARIDAGTTWRSRTPSSVTAESTDGGKTLVFTLRYPNQPNATFSVDTSVAGKVYGHEYYQGAITGATNIFSKNMNTDSVFHINAAQDFFRFVLRGESGVVEGYFGERLSATTKLPTSGVSTYDLRHRVISPYDNNAYAAGGMKLFVNWTSGKVYGFESNASLAGGTGTALFIGDIDRSGLEIDGQYVFKTRRLTTAENSSIPRYIRDAMRETTSLQFYGSAYPNGLGGTFGSTFYNEAGSPTLSSMLMSGYVNEKTVTKPYSPANNEVWSGYAVGLVANRSTGAVAVAYNTNPNDVQMTLRPVSATAKADITVRDGGTAYNFGSDWSDTSVYINKDAFAAIKEINGVPSYAATTMTEDDGYNYLSWGVWSTELVATPNTSVMDGSHWIAGTLTPTTSMPVTGSATYTGQIRGTAHEGGALHALNGSTNLTANFGTGNISGQLNVQYANTGAAYATSNLSGVTISGNQFGGSLSGSNNAGAIQGGFFGPAAQEVGGNWAIEKTSGSKAAGVFSGKR

SEQ ID NO: 939 - DNA, 1632 bp, N. nitrogenifigens
gtggccagcgccaacaccacgccggccagcaattccagccttgccaaactggtggcaagccagagctttgccaacgacggcgccagccagaccgcagccttcgatctcgtcaccggcaacaccaccgccggttcgtcgaccgcgaaaccgctgacaatcagctatgatgcgacgtcgaacagctacacgatcacgacgcagggacgcagccagactttcgcgcctgccgacatggccagcgccgccaacggcattgccgtctacagcaagacgagcggcacgacgaccgaccggctgaccatgctggccgccaatgtcaccggctacaacagcgcggcgccgcaatattcgggccttgcctattggcagcgctacagcgtcagcggcaccggcgaggcaacgaccttcgacattttcacctacggcctcgacacccctgcctcggccgtaccgcgcaccggacaggccgcctatgcgaccacggtcgtgggtctggtcacgctgcccggcaccgaggcgcgcatgttccaggggaccgggcgactggacgtcgatttcctcgacgggatcctctcgaccagcgcgacgaccaccgaaaccggccttgcctcgggcgcggtcatcggcggcacgggttcgctcaccggaacgggaaccctgtcctcgtcagccaatgcctttaccggcacggtccattacagcggcagcggcaacagttcgagcggcacgctctcgggccgcttctatgggccgagcgcgcaggaactgggcgcagccttttcctccagcggcagtgacggcagcgcggcaagcggcgcgatctggggcatcgccagtcccggaacaaccccgatcaatctttccgtcgcaaatcccgcgaccgatcagacttatgcggcagcagccgctgaactcgactcaacgccctcgaccggcagctcgaccagccttggcacgaacccgcttgccgtcacaactgcaggcgacgtcacgatcggcgggggcagttcgtacctcgcgcagaccacgctggccaacagcgacagggtcgccgcgaccgacaccaatttcacctcgttccagaaaaccgtgaacggcgccaccgtggcactcgacatgtaccgccccgggaacagcgaactcgcactcacctacatgagcttcggccgctggcgggaaactcccgatgccgccgcgcaagggacctcgatctacacctatttcgtctatgggctgacgaccgacgccgccacactcgcggcccgcaccggcaccgcccattatgccggcgtcgcctatggcaccgcattcgacagcggcacgggaaccggcaacgccgtcaagggtgcctcggctttcgacatcgacttcaacatcggcggatacgccgggaccatcgcgctcaagagcagcagcaccgactacggcacgttcaacgcatcgggaacgctgtcctcgggaatgcccgcgcaaggcagcctgaccggaaccaagggcggaaccgggcagatcacaccctcgttctatggtcctgcggcacaggaattcggcggcccgttccggatctcgatttccggcagcggcagcgccacgacaacgatcgtcggcgccacggtcacaaaggccaattga

SEQ ID NO: 940 - protein, 543 aa, N. nitrogenifigens
MASANTTPASNSSLAKLVASQSFANDGASQTAAFDLVTGNTTAGSSTAKPLTISYDATSNSYTITTQGRSQTFAPADMASAANGIAVYSKTSGTTTDRLTMLAANVTGYNSAAPQYSGLAYWQRYSVSGTGEATTFDIFTYGLDTPASAVPRTGQAAYATTVVGLVTLPGTEARMFQGTGRLDVDFLDGILSTSATTTETGLASGAVIGGTGSLTGTGTLSSSANAFTGTVHYSGSGNSSSGTLSGRFYGPSAQELGAAFSSSGSDGSAASGAIWGIASPGTTPINLSVANPATDQTYAAAAAELDSTPSTGSSTSLGTNPLAVTTAGDVTIGGGSSYLAQTTLANSDRVAATDTNFTSFQKTVNGATVALDMYRPGNSELALTYMSFGRWRETPDAAAQGTSIYTYFVYGLTTDAATLAARTGTAHYAGVAYGTAFDSGTGTGNAVKGASAFDIDFNIGGYAGTIALKSSSTDYGTFNASGTLSSGMPAQGSLTGTKGGTGQITPSFYGPAAQEFGGPFRISISGSGSATTTIVGATVTKAN

SEQ ID NO: 941 - DNA, 1140 bp, N. pentaromativorans
atgaccctaattagcgaacggcaacatcaacgcggcgggacgggaaaattcatcctgctcggctcggttgcggccatgacgctcggcctttcggcctgtgtcggcgtgcgtattccggaagatgcgttcttcggcgaatgcacaacctgtccgccgattcagccggacgatgaggatcccaaccaggaagcccagatcggagcggtctccgaacccggcctcggaacgaaccccatcgtaccgacttcgttcgacgaactcatcgctggctcagatagtgacaccgaccagacgataaagctccgtctcgtccaatcctcgcgcgcgctttcaatcggcgatgtctcggtttcctcgtccgatcctgcgaccgacgatggcggggcgcacttcacaatcacgatacccgccgatcccgatagcgagacgataaccacgttcacgctgggcaacaatgccttgggggtcaaggacgtcgcctttaccgaagacgattacgaatcccctgtccggaatgtgaccctgtcagacggcagaaagctctcggtcgccatgtttaccgaagacaggaatacgcaggaagcaggcagtgaactcgactggaccgtgtacggcagttggggcatccgttccgcgacgaacatcccgcaaagaggcgcaacgttcgtaacggggatcgaaacgtcggacagcgcaatcccgacgagcggcacagcgaccttcaacggcttcgtggaaggttctgtcacggtgcccagcggaactgccatcgacaccgcttccatccggggcgatgcgacgatcacggccaattttgcgaacggtacgatatcgggcgcggcgtccgatattactgccattcccatcggcaccctgcccatgaccggaccggttacaccgggttccccacaagcgtggaacagcttgagtttccagggaaccatgacaagcggcctgaacggtttttccggggccacggccgtcacctccgctccggaaggcgcctattcgctgctcgacagcgcaaccggctattttgccggcatgttctacggcccgggcgcggaagaactgggtgctgtctggaacctctacgatggcattggtgcagccaccggcgtccttatcggaaagcaatga

SEQ ID NO: 942 - protein, 379 aa, N. pentaromativorans
MTLISERQHQRGGTGKFILLGSVAAMTLGLSACVGVRIPEDAFFGECTTCPPIQPDDEDPNQEAQIGAVSEPGLGTNPIVPTSFDELIAGSDSDTDQTIKLRLVQSSRALSIGDVSVSSSDPATDDGGAHFTITIPADPDSETITTFTLGNNALGVKDVAFTEDDYESPVRNVTLSDGRKLSVAMFTEDRNTQEAGSELDWTVYGSWGIRSATNIPQRGATFVTGIETSDSAIPTSGTATFNGFVEGSVTVPSGTAIDTASIRGDATITANFANGTISGAASDITAIPIGTLPMTGPVTPGSPQAWNSLSFQGTMTSGLNGFSGATAVTSAPEGAYSLLDSATGYFAGMFYGPGAEELGAVWNLYDGIGAATGVLIGKQ

SEQ ID NO: 943 - DNA, 1062 bp, N. pentaromativorans
atgatggaagatttccttcctcgcgcgagcgacattcgccgatgcttgcgggtgggcagtgtccttggcattcttggactggccctcgctggctgcggcggtgacggcggcgtcaacagcgccaataccacaccgggtccgatagctacacccgctccgcctcccacaccatcatttaccgggaccccggtcggattcgtcgaaatttctgggaaatatcaggttgatggaactgagaccttgaaagctgatggtccatacgatctgtccgaaaatatcctggcaatcgaggtcgaggaggcaaccaacacctatactgtcactgttgaaggaaactatattaccgaggtctttgacccggaggcgaatgtcggccctgcacaaccaaccgacgaacccggcaattttctctattatcgcaaggaggccggtaccggagtgaagagcctggaagtgctgagacaagatccgggtaacgaccggttgcaacttcaatatctgagttacggcctttggacggctgttgaccctcacgcccctgaagagccccgcaatgtctcggcatattcattcgtgtttggccaatcgaccgagaaggcgaacctgcctgccacgggaacggcgatctataacggtattgtcgacggttattacggaacttaccggttgctcggaagtaccggcacgctcaccgcggatttcggggaatggaccgtatctaccgaactttcgctgcgcacagagggtctgcgtatcgcaaacgatcccgcgcttgcgacaggagccggtttcgagatcggtactctaagcggcaccggcgatatgggctgtccgatcagctgcggcgtcgacgactatggcgccgatgacaacgcctattggggatcgctctccggaacactggaaggcaattcggtttccggctcgttcgacggattgttctttggtccaggcgcggaagaaacgggattcagcttcgaggttaacacctatccctatgacccggcatcagggtcttcacctgggccgagcgccgccggcgtcttcgtaggcaagcaatag

SEQ ID NO: 944 - protein, 379 aa, N. pentaromativorans; identical to SEQ ID NO: 942

SEQ ID NO: 945 - DNA, 1269 bp, N. pentaromativorans
atggctcttccatcgcaaggtagcgccatccatcgcaccctcccccctccgttcagaactttggtaccagggaaggtggttcaatccagttctattggagtcaccgcgatgtcgaggatttcgccagtttcacatcgtagcatcagacagcaattgcacgcatgcggattgctgctggcttcgtcccttgtgctcgcaggttgcggaggcgggggcggcttggccagcgttagctccgcacccggtccgattgcgccctcgtcaggggaggtcacggccgatccgcaggcggctaaggaattgatcgtcggcgatgcccttgctcctacgcccgcactgaccagtggaggctacgacacgatcgctctggtaatcgaagaagacacccccccttcgtttctcgcacctggctcgcttacggttgcggtcgacagcacgacgaacacctactcgttcactttcgatcctgtcgccgtgcccgagctatccgccaagtcgtttgatgatccagatgggcagatcgacttccaggtcgacgacgaagcctacggccatgaatacgtagcgacgtttagtgaggacggcgtactcgtcagtgtcgaaggcgaaggacgaagcgcctccctgtacagccatattttcgacgaagcgatgttcaccacatctgtcggccaaagctatgtttcgctgggccaatggagctggccccataccgtcactgacgcaaacggagtgctgtggaccggcgattgggtgggtgggagcctactttacgtctatggagatcgcacggcaccaggagatattcccactttgggcactgccacttaccgggttgcgtctgccaccgacattttagcgactgtgccaataaatacagcaggaggcataaaggacttcggcaacccaggccctttcaatctcgacatagcgatgactgctgactttggagcgcaatcaattgcggccgcagtagaatacgatatcctttccgatgacgtcgaagcttatcactacgatctttcgggacacgcaccaatctccgaactcggcgatttcgatattgcgctgagcggatcacggcttgctggttcattttctgaagggatgttcgcgtctgggtccgagcttgcgacagcttcgccggacggccagttggtcggagccttcttcggtcccaacgccgatcagattggcggaacgatggcgattccgggatctcgcgactacaacatgattggcgtggccttcgtcgcgacacagccttga

SEQ ID NO: 946 - protein, 353 aa, N. pentaromativorans
MMEDFLPRASDIRRCLRVGSVLGILGLALAGCGGDGGVNSANTTPGPIATPAPPPTPSFTGTPVGFVEISGKYQVDGTETLKADGPYDLSENILAIEVEEATNTYTVTVEGNYITEVFDPEANVGPAQPTDEPGNFLYYRKEAGTGVKSLEVLRQDPGNDRLQLQYLSYGLWTAVDPHAPEEPRNVSAYSFVFGQSTEKANLPATGTAIYNGIVDGYYGTYRLLGSTGTLTADFGEWTVSTELSLRTEGLRIANDPALATGAGFEIGTLSGTGDMGCPISCGVDDYGADDNAYWGSLSGTLEGNSVSGSFDGLFFGPGAEETGFSFEVNTYPYDPASGSSPGPSAAGVFVGKQ

SEQ ID NO: 947 - DNA, 1014 bp, N. polysaccharea
atgaaatacaaagccctctccttactgccgcttgccgccgcccttgccgcctgtgccggggggggggtagccgaaccgcacgtccccgtgtccatccccaccgccacgccgctgaccgccggcgaggtaacgttatcaagcgataacggcaacattgaaaacatcaacaccgccggcaccggaagcacatccggcatttccattcagcagcgggaagtagaaaaagaacctttccccgactacaaaatcaaagaaacatcattcatcttcaaaacacccggtggcgcgcaatacgccctttcaacctacgccgaccccataataccccccagcaacgaaacccccgatttcaaaatgcccgaccgccacgccggccagcggcttgccgacggcagccgcatctttatctgttgcagcgaatccggggctaacgatttcgcagaaatcaccaagcaggattatatgaaattcggggcgtggataggccccaacggcaaaatcgacctcttcgccggcggcttccccgtcggcaaaacgccggagtctgtcggcagcaccacacccgaaaccaaaggcaaaatcacttatcaggtttggggcatccgcgtcagaaacgggcaatttgttacctcctcttatacgccgcccaaaggcagcatttattacggttatgaaaacacccccgtcctttcctttattaccgccaatttcaacagcaacagactggcaggcgaaatccgcggcaacagcgattacggaccggatgtggaaattaaagacgcaatgattgacggtctgaacttttccggcactgccacctccggcggcaaaaccggcaacttggaaggcaagttttttggcaaattcaacggctaccgcgacagcgaaaccagcataggcggcaaaatcacttttcaagacgaccgctccctcgataccgtattcggcggcgtgagttatgaaaaaaaacctaatgaaaccactgatatgagtaccgaccatctcaaaaaataa

SEQ ID NO: 948 - protein, 337 aa, N. polysaccharea
MKYKALSLLPLAAALAACAGGGVAEPHVPVSIPTATPLTAGEVTLSSDNGNIENINTAGTGSTSGISIQQREVEKEPFPDYKIKETSFIFKTPGGAQYALSTYADPIIPPSNETPDFKMPDRHAGQRLADGSRIFICCSESGANDFAEITKQDYMKFGAWIGPNGKIDLFAGGFPVGKTPESVGSTTPETKGKITYQVWGIRVRNGQFVTSSYTPPKGSIYYGYENTPVLSFITANFNSNRLAGEIRGNSDYGPDVEIKDAMIDGLNFSGTATSGGKTGNLEGKFFGKFNGYRDSETSIGGKITFQDDRSLDTVFGGVSYEKKPNETTDMSTDHLKK

SEQ ID NO: 949 - DNA, 858 bp, N. polysaccharea
atgatgactttgaacaaagttttctcattgagcatgattgccttgggtttggcggcgtgcagcagcaacggtactgccaacaacggcaacaactctttagtttccggtcctggcgtggcaacacaaggcgcggttgtcagttctttttacggcgtaaaagatgatgtaaggaaagctgtcgacagttgggcagtcaataagggattcaaacctacagaggttgagttggcatcagttacccagcaggttggcagcgtctcctccaagggcagcaatatcaatttgtttgatgtcgtaccggcacaaaacaaggttcaaaaagtggatactgtaaccacagcacgtgttaaagccggcggggacaattacgagctgatttcaaaaggtcaggcacatatctaccgtcaaaattattctttaattgccggtctttccgaactggaaagaatcgaaaaagacccgtccggtatcaagagaaacttggatgtcgatgatgacgttgatttggttgtgaaaggttctgctaccaaaatcctgccagctgcgggcaaatttagctactcaggtattgcaaccgatggcgaaaaacaaggtgctttgtcttatgtagttgatttcgagaaaaaaaacggcaaaggcgaaattaccggaatcggcaaaaccgacatcactctgagtgaagcgcctatcaaagaattcagccataccaacgaattcgataacacagtaattaagggacacggcatcgaaggttctaattacaaactcggcttcttcggtcctaacgctgaagaaatcgtcggtgcggttactcagggtacaaatagcatcggctttgccggctcccgtccgcattaa

SEQ ID NO: 950 - protein, 285 aa, N. polysaccharea
MMTLNKVFSLSMIALGLAACSSNGTANNGNNSLVSGPGVATQGAVVSSFYGVKDDVRKAVDSWAVNKGFKPTEVELASVTQQVGSVSSKGSNINLFDVVPAQNKVQKVDTVTTARVKAGGDNYELISKGQAHIYRQNYSLIAGLSELERIEKDPSGIKRNLDVDDDVDLVVKGSATKILPAAGKFSYSGIATDGEKQGALSYVVDFEKKNGKGEITGIGKTDITLSEAPIKEFSHTNEFDNTVIKGHGIEGSNYKLGFFGPNAEEIVGAVTQGTNSIGFAGSRPH

SEQ ID NO: 951 - DNA, 798 bp, N. rosorum
atgaaaaaatccattttagccaccgcactttgcctgtcctgcaccgtcgcgctcagcgccaacgccgcaattacctcaggcacctccaacaacaaagcggcgctcagcgtaaaaaatgcctcagctaaacacaacggttggttccattccgatcccggcggattaccgggtatcgaagtacaaggcgtcacctctaaagtcaccagctttaaatcgctgaccggtgtcgccaacaatgctatggtgccgaaatccttgggcggtcaggataaaaacggtgttgtggtgttaaacatgaacaacatgccaagctgggtgccgggctttcatggcaagttaggcaactttgcgtttaaaaaagtcggcacgcaggaattgtactacggcgaatggctgggcaacggcgccaatgccaagcaggatcgggttgtgtattatgccggcaataataaaaccgacaacatgccgaccggcggaaaagccgtatatagcgtacagggcattaataatcacggcaaactggatgcggaaatgctgaaaggcgagctgaccgccgacttcggcaaaaaacaagttaacggttcaatgagtaaaaccggcctaacggtgaatatcaataacgcccaaattaatccggctgatgcaagtttctccggtgataaagccgccagtgcaaatggtgtggtcggtagtgtcaagggtaatttcttcggcaataatgccgcggcgttagccggctatgcgaaattcgcaggccataatcaatatgacaccgcattcggcggaagtaaaaaataa

SEQ ID NO: 952 - protein, 265 aa, N. rosorum
MKKSILATALCLSCTVALSANAAITSGTSNNKAALSVKNASAKHNGWFHSDPGGLPGIEVQGVTSKVTSFKSLTGVANNAMVPKSLGGQDKNGVVVLNMNNMPSWVPGFHGKLGNFAFKKVGTQELYYGEWLGNGANAKQDRVVYYAGNNKTDNMPTGGKAVYSVQGINNHGKLDAEMLKGELTADFGKKQVNGSMSKTGLTVNINNAQINPADASFSGDKAASANGVVGSVKGNFFGNNAAALAGYAKFAGHNQYDTAFGGSKK

SEQ ID NO: 953 - DNA, 1083 bp, N. rosorum
aaagcgaaggcggaagcggctcaaaaagcagcggaagaaaaagcaaaagcggaagcggctcaaaaagcggcggaagagaaagcgaaggcggaagcggctcagaaagcggcagaagaaaaagcgaaggcggaagctgaacgcctagcagcagaaaaagccgaagctgagcgtatcgccgcacaggttgcgaaattagaaaaactggcattggcggcgggactaacaaaggaagaagcggctcaatttgctaataattatgtgaatgcttccgaacaagatgccgaagcggaattaagtcgtttagcttatgataaagccattgagaaggaagaaaaagccagaaaatctttgtataaagaagcgattgccgccggcctgacggaagaaaatgccaatgaatatgcacagaataatgtgcataccgatgaagcaaccaaaaaacaggtattagaacaacttgttattgatcagcataaaggcattaaaagtgcaagctataaagatggttataattatgtcggttattcagaacaagcagataataccaccacttgttccgaaaacaattgctcaacttgggatggtaaaacctctacgagtgaacgactttacaatcaaaaatattctgtagtgcaatatgtttcgacgaacaaagccggattattaaataaccaatacattaatgaagatactaccaccgttgaggcaaaagggcttaaaactgctgcgtcagcaatgcctaacgaaggaaaagcggaatattcgggtcgcgtcattcacccgtatggcggcgagctgggatatttaacctataatgtggattttaatgaacgaaaaggcagtggctacgttcaaggccttccgaactataatactaataaggttcacttgaatgaagggactattgataaatcggccatttcatccactgtaacggcaggtgttgatgaacgtggtgagtacactgttgaattttttggccctaaagcggaagaaatcggtggaaaaatggttattcataacccgattcttggtgagcatcatttcggcttagccggtaagcgcggtgaaattacaaaataa

SEQ ID NO: 954 - protein, 360 aa, N. rosorum
KAKAEAAQKAAEEKAKAEAAQKAAEEKAKAEAAQKAAEEKAKAEAERLAAEKAEAERIAAQVAKLEKLALAAGLTKEEAAQFANNYVNASEQDAEAELSRLAYDKAIEKEEKARKSLYKEAIAAGLTEENANEYAQNNVHTDEATKKQVLEQLVIDQHKGIKSASYKDGYNYVGYSEQADNTTTCSENNCSTWDGKTSTSERLYNQKYSVVQYVSTNKAGLLNNQYINEDTTTVEAKGLKTAASAMPNEGKAEYSGRVIHPYGGELGYLTYNVDFNERKGSGYVQGLPNYNTNKVHLNEGTIDKSAISSTVTAGVDERGEYTVEFFGPKAEEIGGKMVIHNPILGEHHFGLAGKRGEITK

SEQ ID NO: 955 - DNA, 1011 bp, N. shayeganii
atgaaattgattctaaaaaccgtatcggccgcatctttggcggctgtattgggtgcttgtgcaggaggcggtgcggtgcatatacccgattcaacagcgactatgccaacggtttcccctttgaatgtttctgatgtgcagcctctgcaaggtagttatacgggtcataatttcaatgcggctcagccggtgtcgtcacatagcaatccggctgttggaacacttaaagcagtgagcttgccaaaagaggttctgcttaacgtttataatgatcgcaagaacgtattcatttatgaaacggcagacggtaaacaatatgctttgttaggaaccggaaatccttttgtgcccacggcagcgacgagtgtttctgttgctccgccaagagtgaaaatgtcggaaaccgcagcaggggataaatttattgtgtgttgtgatcagttttataatagtaggtttataccagcccgagtcggtgatcacgacgacgggggggtgcgctatggcgtttggatttcagcttcaggtagggttgatatgttttacgggggcacgcctgctgttccggctcaaatgttaggggcttctggtaatggcggggtgcctaggggaaaagcaacttatgaagtggccgccttccgggtgcgtgatgggcaagcggtgatgtctacccatgatgttgcaaatacggcgaaccgatcattgttaactgtcaattttaacagtaggaaaatgggcggtaccattttaggtaatgcggaatttggcgacaatattgtatttggtgatgtgtctgtcgacggcgccagcttttctggttcggtaacttcggctggggtgagcggacaagtagaaggaagtttttatggacgtaaccatactaccgggagctatatcggggggagagccgtttttaacggcagaaatgacttagacagtgtttttgggggaagtattcgtagacaaggtcaagcttcctatgtaggggatgatgtcaatcatttggactaa

SEQ ID NO: 956 - protein, 336 aa, N. shayeganii
MKLILKTVSAASLAAVLGACAGGGAVHIPDSTATMPTVSPLNVSDVQPLQGSYTGHNFNAAQPVSSHSNPAVGTLKAVSLPKEVLLNVYNDRKNVFIYETADGKQYALLGTGNPFVPTAATSVSVAPPRVKMSETAAGDKFIVCCDQFYNSRFIPARVGDHDDGGVRYGVWISASGRVDMFYGGTPAVPAQMLGASGNGGVPRGKATYEVAAFRVRDGQAVMSTHDVANTANRSLLTVNFNSRKMGGTILGNAEFGDNIVFGDVSVDGASFSGSVTSAGVSGQVEGSFYGRNHTTGSYIGGRAVFNGRNDLDSVFGGSIRRQGQASYVGDDVNHLD

SEQ ID NO: 957 - DNA, 1950 bp, N. sicca
atgcacactcaaaataaatcacctattactcattttgttctaagcggtatttgcgttgcaattttagcagcctgcggcagttcaaatggaggtggagattcacccaaaaatctatctgtagccccaaaaaacaacgtcaataaagatgacgcaaaaaaagacaataccaacaaaaacaactctagtaaggataattctgacaaaggtactaccaataaaaacaattccaacaaggttaacactgacaaaggaaatgccgacaaaaataatgccaataaagataataaaactaacactaacaaagaaacattattattaaataaaggcattcaggataaactgaccacactaaaactaagtgatgtaataaaaactgaacaattcaatcaaactgaagtgaataccggtttcattgcaaataacttaagtgcgaccccattattagagacagctaaaggtccacatgatcaccctacctctcaccttttaacatccgcttatagaaaagataaaaccaaacttttgcgccctcaaacagttatattagggggtgtagcaacgcgttactttaccaactatacagatggttatgttgcgaagagagccggttatgacgagattgatacgccattaagtgcaaaaaatctgattggtgtagataaacgcaataaaaatggcatcttagttaaaaatggcaggagcgttaacatcttagatcaaactgccagcaaactggaattagatagtgtaggcggtagccgttatacaaaatggtttaataattttgctactaatgccgataatgaaactgaattggataaaggccgccgtgtattaacagatgtgaaatacaaattagatgcaaataataatcctgtatggactgtaactaccgaacccagcagcggttatcaatatgcacattctttaaatcgttattttaacaataatccagacgatgaattatatgttaaccaaaacggtgaatatgcatatcgttttacattaaaaaaatcaactacatttgaagtcagtgcagaatcagcaaaaacccatccggaacgtgcagaggcgctcaaagcattagggtggtctgctggcaagcaatatcacttcgcaccaggtagctactttatggttacacaaaaagatggcagcctaaaaattgtagccgataacggacaaatgacgcaggtatccttatattcagtccatgtcggtattgatgacaataaagcattgggtgcattccaaaataaacgtgtaattgccgaaatgttcagtgcattaaactatggcaagacaaatgaaattcgtgcgatttatacctatgacgttggacaagccaatggcttcaaccaacaatatctctcattaaacgcatggcgctataaaaatggcgatggcacttatggactcaataatccttttaacatcggcattttcgaccgagttgctactgaaaatggtatagttgccaatgtctatgacatgaagactaaaaaaggtttatctgccaaatatacaggcgttgcctattctagccgagatggtaaacaagacggtgtgatgaatatgactgcacagttccatgaaccagatatggcttacaacaatactgtttcaagcaataacgttaccttcaatggcgcgattaccaaccgtcgcctagatgacaaacgtaatgtatattttgccagcggtaatgtaaaaacagagagtggaatgccttctgcaagcgcggggcaaaaagtttctctagtgggtagaagccaagttgctcaaaatgttactgtctggatggaaggaaaaaaaccaggtgaaaataaagtaatttatggtcaaggtaacgtacgttttgccggtccaaatgctgaagaagtcggtggtttgttaaaaatcactaccagccatggcgaaaacaatatcggtttcattggcaaacgctaa

SEQ ID NO: 958 - protein, 649 aa, N. sicca
MHTQNKSPITHFVLSGICVAILAACGSSNGGGDSPKNLSVAPKNNVNKDDAKKDNTNKNNSSKDNSDKGTTNKNNSNKVNTDKGNADKNNANKDNKTNTNKETLLLNKGIQDKLTTLKLSDVIKTEQFNQTEVNTGFIANNLSATPLLETAKGPHDHPTSHLLTSAYRKDKTKLLRPQTVILGGVATRYFTNYTDGYVAKRAGYDEIDTPLSAKNLIGVDKRNKNGILVKNGRSVNILDQTASKLELDSVGGSRYTKWFNNFATNADNETELDKGRRVLTDVKYKLDANNNPVWTVTTEPSSGYQYAHSLNRYFNNNPDDELYVNQNGEYAYRFTLKKSTTFEVSAESAKTHPERAEALKALGWSAGKQYHFAPGSYFMVTQKDGSLKIVADNGQMTQVSLYSVHVGIDDNKALGAFQNKRVIAEMFSALNYGKTNEIRAIYTYDVGQANGFNQQYLSLNAWRYKNGDGTYGLNNPFNIGIFDRVATENGIVANVYDMKTKKGLSAKYTGVAYSSRDGKQDGVMNMTAQFHEPDMAYNNTVSSNNVTFNGAITNRRLDDKRNVYFASGNVKTESGMPSASAGQKVSLVGRSQVAQNVTVWMEGKKPGENKVIYGQGNVRFAGPNAEEVGGLLKITTSHGENNIGFIGKR

SEQ ID NO: 959 - DNA, 1197 bp, N. wadsworthii
ttgacggcgccgaaaacggcgttacggtttggagaggatataacggtagcaaaagccgcacttaatatcggcccgatgctgatcagcagcatcagggtggaaaaaggcgcttcgctgacctgcgggtttgaaagctcggtaggcggcattgcgattaaaacactggaagccgacgatattgtaaagcccgaccgcaaattcggtgccgatatccgggtggaagcggccaataatatggcgggtgaacgtgttcccgacctcaatctggtgggcacacagctgcgcgtcagctatcaagatttggccaaccattttcacaagttgcctaaaaaagcaggcggcgatgccaaaacattcgggcatgatcaagctgcgcgggttgccgtggcggccaaaaccgatcgcacggagctggtggccgcttatgcctaccgctatcacggcaaccattatccaggtaagggcggcaagcaccgttatgagcagatttatcatgcagggggagtgatcattcccggtattgcttcacaaaatattcaggagaatatgtttgaagagcgtagcgaagtattgaacacttctttgaacaaccgctattttttgctgaaaggtacgttcaaacttaccgacaaacagtctatccagcttggctaccgtcgcttggacagccgatacggtgaaattatgccctcaaggatttatggtatagaaacaagagacggccccctactgccgcaatggcctttaagcaaaatcaaaatggatacctacacgctggattaccgctggaagccagaaaaccgctggcttgatttggaaagcggcatttggttgaacaaagccgatatgatgctgcaaaacagcggtggcatggtttacgatttgggcaactataaaaattcgcgaaaccatagcttgagtagcctgcagagaaccaccgttcttcacggctcgctgaataagaacaccaataaccgtttgggcgtttacctgaccaataaaatgaagctgcacgacactttaaacttaaccttgggcggcagctatcaatatgaaaagctcggcacgccggacgatacttggaggaagttggcggagcaagatgtatcttgggtagcacgcctaggcaaggtaaacgggatgaatataaactttatttcaatttcaattggcggccgacagaccggatttcggtaa

SEQ ID NO: 960 - protein, 398 aa, N. wadsworthii
MTAPKTALRFGEDITVAKAALNIGPMLISSIRVEKGASLTCGFESSVGGIAIKTLEADDIVKPDRKFGADIRVEAANNMAGERVPDLNLVGTQLRVSYQDLANHFHKLPKKAGGDAKTFGHDQAARVAVAAKTDRTELVAAYAYRYHGNHYPGKGGKHRYEQIYHAGGVIIPGIASQNIQENMFEERSEVLNTSLNNRYFLLKGTFKLTDKQSIQLGYRRLDSRYGEIMPSRIYGIETRDGPLLPQWPLSKIKMDTYTLDYRWKPENRWLDLESGIWLNKADMMLQNSGGMVYDLGNYKNSRNHSLSSLQRTTVLHGSLNKNTNNRLGVYLTNKMKLHDTLNLTLGGSYQYEKLGTPDDTWRKLAEQDVSWVARLGKVNGMNINFISISIGGRQTGFR

SEQ ID NO: 961 - DNA, 2067 bp, N. weaveri
atgctaaagtttttatttttaattaaaaataaattaaaagttttaaggagatggttaattatggataagtttaaattaagcatgattgttgttgcatgctcattagcattgtcagcatgttcaagcggaggctctgctcctgctaatccgttggctcaagatactccaggaaaaggtgctgcaacaggtggcggtacgggtggttcgcagtctggaaatggaagtagtagcggcagtggcagcagcaccgaaggcagcggcagcaataccgagggcagcggcagcaacaccgaaggcagcggcagcaacaccgaagatagcggaagcggtgatgtgactgttgaacaagctgatccggcatcagttgatttcagtgcgacatttaaagccgatacagacggtttgatgcaatcaggtgtaagaaatggtgcatcggttacctatgaagataaatcaggtaaggttctgtcttcaggcacttcagctttggcagatcaatatgatacagaaccgcataagctggagattgacagtaaagcggttcataaatttgataagtattctttttctacttctgatgatgaaaaaaataaagatattcagattgtgaaaaatttccaagtagaagaaggtacgggcaaaggtctttttggcactgtgggtgaggaccatgttcgttacggtgtttatcaagatcaaggcaagagtacgttgtttgtacatggtgagcctaaaggttcttatggtaatatgcctaaagaaggcaagttcacttttaaaggcggtgcggtttatggaaaatcaggtaattacgtgccggcgctgtcacatgtaaacgtagattttggggatactaaaaatgtgaatatccgcattacgccgagcaacaatcatgctgcttttgatttttcaggaaaaattaacggcaatacctttagcggcgcagatggaggagtaaaacaccgaggcggattctttcgggcaggatggagagatgaagcaggatatgccggtggcgttttccaaagaaccgagggtgagtttgcaggttaccatggttcttatgcttctaaaaaacaggcggcatatgaagaattcaatgctcaggttgccccgcctgcggttcctgaagagcctaaaccgcctgtatctgaacctgaagagcctaaaccacagccgccggttgttgttcctacgccgccttcaagtgaacctgttccgcctgtttctgtttcaggtgcatttgaagaagcaatgaaaaacggctttgttcaagatgataagtctagacctggttacatgaaatcaggtatcacaagctattacgatcccagtacatatgttaccaatggtgttattttaactgtaggtaaagaaggcaaattcagtgcagtacgtccagaaggtaaagaagctgacagctttagagagctgaagttaaatggacatattattcctctattggctagcggtcaggatttgttaaacggtattagcatgagagcgtttaatgctaaagatttgaagcgagatggcggagtatatgacgaaactaaagacggtaaaggtttagttggttctacaactgatagtttccattcagagggctttaaagccatgcgctttggcgtttatcaattagaaggaaccaaccatctatttgtacaaggtcagccaagccgttatatgcctcctgcaagcgataaagattatgcttatgagggatatgccgtgcatgttgatagtaacaatgcttattcgcgtgttaacggcgtaaaagccaaagtcaattttggtaagaagactgttgatgtgactctgaagccggctggtaatgtgttaggcacaaatcgtccatatgatagtgcgttgtcattttcagccaccattaccggtaatacattcagtagcaatagcggtggtgtaagcaccaaaggcggattctttggtggtctcggtcaggatatgggtggtgtatacaatgttggaacaacctataagaatcctgaataccacaacagcaagggcgtattcggtacaacacaagttgatccaagaaaaagataa

SEQ ID NO: 962 - protein, 688 aa, N. weaveri
MLKFLFLIKNKLKVLRRWLIMDKFKLSMIVVACSLALSACSSGGSAPANPLAQDTPGKGAATGGGTGGSQSGNGSSSGSGSSTEGSGSNTEGSGSNTEGSGSNTEDSGSGDVTVEQADPASVDFSATFKADTDGLMQSGVRNGASVTYEDKSGKVLSSGTSALADQYDTEPHKLEIDSKAVHKFDKYSFSTSDDEKNKDIQIVKNFQVEEGTGKGLFGTVGEDHVRYGVYQDQGKSTLFVHGEPKGSYGNMPKEGKFTFKGGAVYGKSGNYVPALSHVNVDFGDTKNVNIRITPSNNHAAFDFSGKINGNTFSGADGGVKHRGGFFRAGWRDEAGYAGGVFQRTEGEFAGYHGSYASKKQAAYEEFNAQVAPPAVPEEPKPPVSEPEEPKPQPPVVVPTPPSSEPVPPVSVSGAFEEAMKNGFVQDDKSRPGYMKSGITSYYDPSTYVTNGVILTVGKEGKFSAVRPEGKEADSFRELKLNGHIIPLLASGQDLLNGISMRAFNAKDLKRDGGVYDETKDGKGLVGSTTDSFHSEGFKAMRFGVYQLEGTNHLFVQGQPSRYMPPASDKDYAYEGYAVHVDSNNAYSRVNGVKAKVNFGKKTVDVTLKPAGNVLGTNRPYDSALSFSATITGNTFSSNSGGVSTKGGFFGGLGQDMGGVYNVGTTYKNPEYHNSKGVFGTTQVDPRKR

SEQ ID NO: 963 - DNA, 2013 bp, N. weaveri
atgcttaccgcttgtgcgggcggcagcttcgatacgctgaacgtcaaccccgaaccgcccccgctacccgaaccgcccaaagtagaaaaagtacccgaacctcgccaaaatccggaagagcaggctgccttaaaacaacctgccgcaggttttgtgatgaaaggcttgcgccgcaacagagccaagcacgatcaaaacggcaatccgttgttggacgcatcgggcaatcctaccgaagcggaaatctacataccgctcaatcccaacgatgtcgaagccgttaacgatgcagatttgactattcccaagctgaaagaaatgcagaacgatccggcaaaccgcggtgcccatcatgtttatcacacaggcaaacagcaagaaggcaaataccaatatatccgcttcggccacgttactgccgattatcccgaagtaattgaagaaacggttagggataaagagggcgatttaaaatggtatacgcaaagagaaggctggaacgttcacaccttttatcacggcacctctgccgcagccgcccttcccgttgacaacaacgtaaactatcggggtgagtggtatttcatgagcgacgtaaaaaaaggcaaaggaaaagaacccggaagcaaccctcacctcggcaacggttttaacagcctgaaaggtaacggcgatattgccagtgcaaccggccaagcaaatgagactaccgacaaaaaatatacgtctgactttaccgttaatttcgccgataaaagcatgacaggcgggcttcattacgaatcacgcatcgaatccaaaaggaagctgtacgacattgaagcacagctcaacggcaaccgctttaccggaaaagccttatctaaggtaaacgacgactcttcaaccttagacaaagcattttttgctgccgactccaacctgctcgaaggcggtttctacggccccgaagcccaagagcttgccggcaaattcttagccaacgacaactctttgtttgtcgtattcggcgcaaaacgcgatagcgacaatccgaaccaacctaaaaaaaccaatgcattattagacgctttctatattaccgttcccaaacgggttgatgtggagtacgaagaggaagaagaaatcaacgaaaccgacaccgccgcaaacgacgcccttacagaagaagactttaccgaagaagaagaaaaagaacccgaagtccgccaacacctcaccgaaaccgagcgcaaacctttagccaatttcggctatgccatgaaactgcgcttcggcaacaaagttttcgacttggaaaaagctgagcttgacgaaatgctgaaaaacgccaacgccgaaataggttccgacacaacaggcaaaacccacagcattaccctgccggagaacggcgaaggcaaaccccgcgagttcgtgcaggtgtgttgcagcaacttgagctatctgcgcttcggccaattcgtgttacaggaaaaagcagggcaagaccccgtgcacgccctctatcttcaaggcgaaagaacccccgtatccgatctgccgcaatcaggaaaagccacatacttaggcagctggaccggctttatcaaagtacaaccgccgcaacgccacgcattcggcaaccccgactacggtcataacgccaccatgaaaaacatcagctcaagcagcagatccggcgtttcatcatttgacgttgattttgataacaaaaagctgaacggcgcattaatcggcaccgacagccgcagagtattcaatatcgaagccaatatcaacggcagcggctttacaggccgaggctataccgacggcagcttccccttcgacccgggtaatctcactaaaggctattccgcctatgttcccgatgccaaagtggagggcggtttctacggccccggcgcacgcgaactgggcggcacgctgatctacaactcaccggataaagaccaagacagcacagatatccgcgcaggtgcggtattcggcgcaaccaaacaagaataa

SEQ ID NO: 964 - protein, 670 aa, N. weaveri
MLTACAGGSFDTLNVNPEPPPLPEPPKVEKVPEPRQNPEEQAALKQPAAGFVMKGLRRNRAKHDQNGNPLLDASGNPTEAEIYIPLNPNDVEAVNDADLTIPKLKEMQNDPANRGAHHVYHTGKQQEGKYQYIRFGHVTADYPEVIEETVRDKEGDLKWYTQREGWNVHTFYHGTSAAAALPVDNNVNYRGEWYFMSDVKKGKGKEPGSNPHLGNGFNSLKGNGDIASATGQANETTDKKYTSDFTVNFADKSMTGGLHYESRIESKRKLYDIEAQLNGNRFTGKALSKVNDDSSTLDKAFFAADSNLLEGGFYGPEAQELAGKFLANDNSLFVVFGAKRDSDNPNQPKKTNALLDAFYITVPKRVDVEYEEEEEINETDTAANDALTEEDFTEEEEKEPEVRQHLTETERKPLANFGYAMKLRFGNKVFDLEKAELDEMLKNANAEIGSDTTGKTHSITLPENGEGKPREFVQVCCSNLSYLRFGQFVLQEKAGQDPVHALYLQGERTPVSDLPQSGKATYLGSWTGFIKVQPPQRHAFGNPDYGHNATMKNISSSSRSGVSSFDVDFDNKKLNGALIGTDSRRVFNIEANINGSGFTGRGYTDGSFPFDPGNLTKGYSAYVPDAKVEGGFYGPGARELGGTLIYNSPDKDQDSTDIRAGAVFGATKQE

SEQ ID NO: 965 - DNA, 729 bp, N. weaveri
atgaacatgaaaaaaactgccctggctttgatgactgcattggtatgtacaggtgcttatgccggttccaactattaccaccccgacgcatattgggttcctgccaagaaagtaaaatggggcaaagccgcttctgaagaagtaggcgaaaaagtattgaaaaacgcggctaaaaaatcgcacgttcactacaaatacctgaaccactacaatgttgccgccgatgcgaacaacgtgaaaaccatccacgcctacaaccaaaaacgcggcaactacatgggcaacttcgcattcagcaccatcaagagcggcggttccgaagtttactacggcgaatggaacggtaccgagtatgttaaaggcaaaaaccgcgccgtatactactccggcgacaaacgtgctgtaaacatgccgatggccggtaatgcaacttacaacgtacaaggtatcaaccactacaacggcaacaacgccatgaccggccaactgcacgccgacttcggcaaacgcaccttaaccggctctatgcaaaatgccgctgtgaaaatggacgtatactcaaacatcaacccatacaaagcgtcgtttaaaggccacgcagttgccaacggtcacttcggtaaaaccgaaggccacttcttcggcgacggcgcaaccagcctggccggtgtagccaagttcaaaaccaaccgcgctttggatacggctttcggcggtaccaaacaataa

SEQ ID NO: 966 - protein, 242 aa, N. weaveri
MNMKKTALALMTALVCTGAYAGSNYYHPDAYWVPAKKVKWGKAASEEVGEKVLKNAAKKSHVHYKYLNHYNVAADANNVKTIHAYNQKRGNYMGNFAFSTIKSGGSEVYYGEWNGTEYVKGKNRAVYYSGDKRAVNMPMAGNATYNVQGINHYNGNNAMTGQLHADFGKRTLTGSMQNAAVKMDVYSNINPYKASFKGHAVANGHFGKTEGHFFGDGATSLAGVAKFKTNRALDTAFGGTKQ

SEQ ID NO: 967 - DNA, 1005 bp, N. weaveri
atgagtaaaaaaatattatgccttttgcctatttctttgttggcggcatgtgccggaggcggaaccgctgaaccaagtacgccttttgctattccggttttaaaagaaacaaagattgtaaacgataaatctgagatttcgtttgaagcaggtatgttgcacgacgatgatagcaagctggtaacgcttcatactttggatgatccgaagcaggcgaaattgcggaagttggatatacatcatcatggtaatttcggtccaagagttgatgatgcttttgtttatcagacacctgatgggaagctattcagattcggtacttataacacgcctatacttcaggatggcttttctccgagctacactcttaaaaattctcatgagggccaggcaacagaaaatggcggacgtttgtttgcctgttgctctttccaatggaggcaggcatctgcgacgagattggacaacgtcggttacggagcatggattgatccgaacggtaaagtcgatttgtttgtcggcggtgtgcctgcagatgtagcgaaaatgcaaggtgcttggaataatgaaggcaagcctaaaggtacggcaatctatgaagtatggggtgttcgtgagaaaggcggaaaatttgtgacttcttcatacaccggcttctcaactccgactgatggcaaatatcctcgtggcaagcctgaggcttcttatattttagttaattttaataccaataaattaggcggaaccattttgggtaatcaagattatggtccggatgttgtgatgggtaatgttgatattgtcggtaatagttttagtggctcggctaagtcaggtggagttaacggcaatgttgaaggtaagtttttttcttctgatggtaaagagattggcggcaaagtggtatttgaccaaaaccgttctttagataccgtattcggcggcatgcgtgataaatataaccctagtgatgaatcgcttgatttacccactatcgccaaataa

SEQ ID NO: 968 - protein, 334 aa, N. weaveri
MSKKILCLLPISLLAACAGGGTAEPSTPFAIPVLKETKIVNDKSEISFEAGMLHDDDSKLVTLHTLDDPKQAKLRKLDIHHHGNFGPRVDDAFVYQTPDGKLFRFGTYNTPILQDGFSPSYTLKNSHEGQATENGGRLFACCSFQWRQASATRLDNVGYGAWIDPNGKVDLFVGGVPADVAKMQGAWNNEGKPKGTAIYEVWGVREKGGKFVTSSYTGFSTPTDGKYPRGKPEASYILVNFNTNKLGGTILGNQDYGPDVVMGNVDIVGNSFSGSAKSGGVNGNVEGKFFSSDGKEIGGKVVFDQNRSLDTVFGGMRDKYNPSDESLDLPTIAK

SEQ ID NO: 969 - DNA, 1992 bp, Neisseria sp. oral taxon 014
atgcgtactcagaataaattgcctattatccattttgtattaacaggtatttgtgctgcagttttggcagcttgtagcagttcgaatgaagtatcagattcagcaagaaatctgtctatagcatccaataatatcaatacaggcaataccgataagggcaataccgataagggcaataccgataagggcaataccgataagggcaataccgataagggcaataccgataagggcaataccgataaaggcaataccgataaaggcaataccgataaaggcaataccgataaaggcaataccgataagggcaataccgataagggtaataaaactaacatcaacaaagaaacgtcattattaaataaaggcattcaggataaactgaccacactaaaactaagtgatgtaataaaaactgaacaatttaatcaaactgaagtgaacaccggcttcattgcaaataacttaggtgcgactccattattagagacagctaaaggtccacatgattatcctacctctcatcttttgacatccgcttatagaaaagataaaactaaacttttgcgccctcaaacagtgatattagggggcgtagcaacgcgttactttactaactatacagatggttatgttgcgaagagagccggttatgatgagattgatacgccattaagtgcaaaaaatctgattggtgtagataaacgcaataaaaatggcatcttagttaaaaatggcaggagcgttaacatcttagatcaaactgccagcaagctagaattagatagtgtaggcggtagccgttatacaaaatggtttaataattttgctactaatgccgataatgaaactgaattggataaaggccgccgtgtattaacagacgtgaaatacaaattagatgcaaataataatcctgtatggactgtaactaccgaacccagcagcggttatcaatatgcacattctttaaatcgttattttaacaataatccagacgatgaattatatgttaaccaaaacggtgaatatgcatatcgttttacattaaaaaaatcaactacatttgaagttagtgcagaatcagcaaaaacccatccggaacgtgcagaggcactcaaagcattaggatggtctgctggcaagcaatatcacttcgcaccaggtagctactttatggttacacaaaaagatggcagcctaaaaattgtagccgataacggacaaatgacgcaggtatccttatattcagtccatgtcggtattgatgacaataaagcattcggtgcattccaaaataaacgtgtaattgccgaaatgttcagtgcattaaactatggcaagacaaatgaaattcgtgcgatttatacctatgacgttggacaagccaatggcttcaatcaacaatatctctcattaaatgcatggcgctataaaaatggcgatggcacttatggactcaataatccttttaacatcggcattttcgaccgagttgctactgaaaatggtatagttgccaatgtctatgacatgaagactaaaaaaggtttatctgccaaatatacaggcgttgcctattctagccgagatggtaaacaagacggcataatgaacatgactgcgcagttccatgaaccagatatagcttacaataatactgttttaagcaataacgttacctttaatggcgagattaccaaccgtcgcctagatgacaaacgtaatgtatattttgccagcggtaatgtaaaaacagggagtggaatgccttctgcaagcgcaggccaaaaagtttctctagtgggtagaagccaagttgctcaaaatgttactgtctggatggaaggaaaaaatccaggtgaaaataaagtaatttatggtcaaggtaacgtacgttttgccggtccaaatgctgaagaagtcggtggtttgttaaaaatcactaccagccatggcgaaaacaatatcggtttcatcggcaaacgctaa

SEQ ID NO: 970 - protein, 663 aa, Neisseria sp. oral taxon 014
MRTQNKLPIIHFVLTGICAAVLAACSSSNEVSDSARNLSIASNNINTGNTDKGNTDKGNTDKGNTDKGNTDKGNTDKGNTDKGNTDKGNTDKGNTDKGNTDKGNTDKGNKTNINKETSLLNKGIQDKLTTLKLSDVIKTEQFNQTEVNTGFIANNLGATPLLETAKGPHDYPTSHLLTSAYRKDKTKLLRPQTVILGGVATRYFTNYTDGYVAKRAGYDEIDTPLSAKNLIGVDKRNKNGILVKNGRSVNILDQTASKLELDSVGGSRYTKWFNNFATNADNETELDKGRRVLTDVKYKLDANNNPVWTVTTEPSSGYQYAHSLNRYFNNNPDDELYVNQNGEYAYRFTLKKSTTFEVSAESAKTHPERAEALKALGWSAGKQYHFAPGSYFMVTQKDGSLKIVADNGQMTQVSLYSVHVGIDDNKAFGAFQNKRVIAEMFSALNYGKTNEIRAIYTYDVGQANGFNQQYLSLNAWRYKNGDGTYGLNNPFNIGIFDRVATENGIVANVYDMKTKKGLSAKYTGVAYSSRDGKQDGIMNMTAQFHEPDIAYNNTVLSNNVTFNGEITNRRLDDKRNVYFASGNVKTGSGMPSASAGQKVSLVGRSQVAQNVTVWMEGKNPGENKVIYGQGNVRFAGPNAEEVGGLLKITTSHGENNIGFIGKR

SEQ ID NO: 971 - DNA, 492 bp, Neisseria sp. oral taxon 014
ttggccgtggcggcatgcagcagtgcgggcaatgaaacggaaatgctgaaaaaccggctctcagaggcgcagacggcagtgaagctgtcggctgaaaacaccaagcggctggaagacacttattcggacatttatttcgagttaaacagcctgacggtggcgaacttcaaaacgaaagtggcggcgggggatactttctacgcctacatcggccgccccagttgcggcgactgcaacgcattcgaaccgatgttcaaacgttacatcgaaaaacaccgcctaggcagcaaaatctattttgtcaacgtgcaccgcctgcatcaggacaaagaagcgtggatggcgttccggcagcagtacaaactgagcggtacgcccgtattggcgaaatattccaaaggacggcaggtgaacaagctggatttggaagacaacggcggcagcatcagcgcggccgatttggaaaaatggctggctttgaataagttataa

SEQ ID NO: 972 - protein, 163 aa, Neisseria sp. oral taxon 014
MAVAACSSAGNETEMLKNRLSEAQTAVKLSAENTKRLEDTYSDIYFELNSLTVANFKTKVAAGDTFYAYIGRPSCGDCNAFEPMFKRYIEKHRLGSKIYFVNVHRLHQDKEAWMAFRQQYKLSGTPVLAKYSKGRQVNKLDLEDNGGSISAADLEKWLALNKL

SEQ ID NO: 973 - DNA, 885 bp, Neisseria sp. oral taxon 020
atgatgaaaagcatcaaattaacccttatcgccgctgccgtatgtgccgcttcctctgctttcgccgctaattatgctggagaaatttctcaggctgaccacaagccaaacgacaggcagattaaagttggtgaaggtaaaacagatgttcataccggaaaagccgcaatcaatgtcatagatgtagctgccacgcctgaaaaccccagaaagggtttggcaaacggtaaatatatttcctttgcaaaaatagatgaaactgcgggtagttttattgtaaatacgtttgctccggatgttttgggtaaggataaaagtggtgtaactgtcgcccatatgttcaaaatgaaaggctttttgtggcggaatattcccaaaatgcccgaccactcccatttaggccgcatgtcttacggcaaagtcggcaatctggatgtctactacggcgactgggacaacaccccgtctggcgcgtctaaggtgaatacagacaccaaaaccaacaactacaccgtgttctacagcggcacgggcaaaaccaccaatatgcccaccagcggtacggccacttatgcggttaaaggcatcaatggtcattacgagcagggcactgccgtattgaaaggtgatttgaaagccgacttcggcaagaaaacgctggcgggcactttgagcagaacaaccggtgatctaaaaaccttgggaattgatgcgaaaatcgtaactaacgatgcttcgttctccggcaaagccgttgccaacggttcggtaaacggtgcaaccaaaggcaacttcttcggcaacaacgccgcaggcttggccggtatcgcccagtttgacaacaacaaaaaactcaatgccgctttcggtggtgcgaagaaataa

SEQ ID NO: 974 - protein, 294 aa, Neisseria sp. oral taxon 020
MMKSIKLTLIAAAVCAASSAFAANYAGEISQADHKPNDRQIKVGEGKTDVHTGKAAINVIDVAATPENPRKGLANGKYISFAKIDETAGSFIVNTFAPDVLGKDKSGVTVAHMFKMKGFLWRNIPKMPDHSHLGRMSYGKVGNLDVYYGDWDNTPSGASKVNTDTKTNNYTVFYSGTGKTTNMPTSGTATYAVKGINGHYEQGTAVLKGDLKADFGKKTLAGTLSRTTGDLKTLGIDAKIVTNDASFSGKAVANGSVNGATKGNFFGNNAAGLAGIAQFDNNKKLNAAFGGAKK

SEQ ID NO: 975 - DNA, 1590 bp, Novosphingobium sp. AP12
ttgatcaatccgagcatcagcgaagtcttcaccgccgacgccggaaccgtttcggcgctctatcccggcgggggcacgagcccggaggtcgagggacgcaccaccctgacgatcgcctacgatgcgaccaacggcagctatacgatcacggctccgcaggcctctcaggtcttccgggcggcggatagggataccgccagcagcgatcgaagaataacgcgttacgtgcgaacgcaagggaccgtcacagatagtctcgtcctcaccaaggcaggtgagagcggcatcttgaccaatcgctatgtcggcggtggcattcagcgacgcaccgacacggcggggggaatccagaacaatcgcctgaacgtgttcacctatggcgtacagacagccaatggcgcggttccgatcacgggaaccgggaccttcgctttcggcatcatcggcatggaggcaggggacgacgtcctcgccgatttcgatggccgcgggaccatgcaagtaaacttcgcgtctgccacgctgacaggggtggggttgaagataacgcgccgcttcaacgataacggctacgcggcattagaccagtcggtcttcacgctcgagggcgttttgggagtgggtggaaacgccttgtccggttcgatccgcttcagcgatgctgctgctaccttggaaggccgcttctatggttccgctgcggaagaggtcggcgccacgttctacggcgccaatacgcgcaaccagatgatttccggtgtactgctcggtcgctcacgcagcacacctggatatgaaacgctcaccgatctggtgatgcctatcgaactccaggcctatacggcggcgattttcgccacacgcaatgccggcacgaacgactacggcgacacctctctgggcagtggggggcagacgtcatttcttgtcgccaccgatcctcgttcgtacaagtacttctacgacttgaacgacggcaaccgcgtagcagcgcaatcggatagccgtttcacgacgtatgtgccggcgtctggacagatgtatcgtatctacaatcccgggccgggtaacgacgaactcgcgctcacgtacacaggcttcggtctcagggaaatgcgcgtagcgggagcccgtgcaatgaacgagaccttcgtgttcggcctcgaaacaggcttctcacagttaccccttagtggccaggccagctaccggggagtggtctacggcagcgccataggggccggcagcaacgccgacctcttcgcgctgcatggctctgctgccttcgacttcgatttcggtcgtaatgcattcaccggatccatgcagcccgcagccacgaatacgcgtacccaggtcacgaccgaccttggcactttgaccttcatcaacccatggatgccaggggcagctatgatgacgagcgccttcgccgccgacatcggcggtccgtctggcacaacgggccgcataactggccggttctacgggccccaggggcaggaagtgggaggaagcttctcgctggttaccccggccgctggaaccgttctgactggggtcggggttgtggccgccgttcggagatag

SEQ ID NO: 976 - protein, 529 aa, Novosphingobium sp. AP12
MINPSISEVFTADAGTVSALYPGGGTSPEVEGRTTLTIAYDATNGSYTITAPQASQVFRAADRDTASSDRRITRYVRTQGTVTDSLVLTKAGESGILTNRYVGGGIQRRTDTAGGIQNNRLNVFTYGVQTANGAVPITGTGTFAFGIIGMEAGDDVLADFDGRGTMQVNFASATLTGVGLKITRRFNDNGYAALDQSVFTLEGVLGVGGNALSGSIRFSDAAATLEGRFYGSAAEEVGATFYGANTRNQMISGVLLGRSRSTPGYETLTDLVMPIELQAYTAAIFATRNAGTNDYGDTSLGSGGQTSFLVATDPRSYKYFYDLNDGNRVAAQSDSRFTTYVPASGQMYRIYNPGPGNDELALTYTGFGLREMRVAGARAMNETFVFGLETGFSQLPLSGQASYRGVVYGSAIGAGSNADLFALHGSAAFDFDFGRNAFTGSMQPAATNTRTQVTTDLGTLTFINPWMPGAAMMTSAFAADIGGPSGTTGRITGRFYGPQGQEVGGSFSLVTPAAGTVLTGVGVVAAVRR

SEQ ID NO: 977 - DNA, 543 bp, Novosphingobium sp. PP1Y
atgcgcatctggccggcaggcgggagcgccacggacttcagctatgtatcgttcgccgaattctatgccagcgcgcctgcaggttccagcctggaaaccgtggcctatggcagcatggcgatcatccagccgacgaggcccggtgaagtgccgatgaccggaagcgccagctatcatggctttcttgtcggctttttcggcggagatcccggcggaagctgggtggaaggcagaagcaggctggacttcgactttgccaagggatcgctgtccggcgaactgaccgccagaatggtctgcatgatgggctgcgcctacgatgaccagctctataccctggccgacacacacttcgcgcacggcgcgaccgaattcggcggtagcctcacgacagcgggcgccccttcggcagggacgtttgcgggcatgttcgccggccccaatgccagcgagctggccgcccagttccagcttcccttcttcaatcaggatttccgcaagtgggtgccggtatcgggcgtcatcatcggcaagggcccgtaa

SEQ ID NO: 978 - protein, 180 aa, Novosphingobium sp. PP1Y
MRIWPAGGSATDFSYVSFAEFYASAPAGSSLETVAYGSMAIIQPTRPGEVPMTGSASYHGFLVGFFGGDPGGSWVEGRSRLDFDFAKGSLSGELTARMVCMMGCAYDDQLYTLADTHFAHGATEFGGSLTTAGAPSAGTFAGMFAGPNASELAAQFQLPFFNQDFRKWVPVSGVIIGKGP

SEQ ID NO: 979 - DNA, 1533 bp, Novosphingobium sp. Rr 2-17
atggcagtggcgtgggatcgaaccactaacaccggcatcagcggcagtacaaaatccgccacgatgactatcgcctataatgcgaacaccaatggctataccatttcgaccgacggctactcgcagacatttctgccggcagaccagacctcaaaggatgattacgacacagtttattccaacaacggagccattctaacccttacttccaaggggtacgagaacaatcttgtcacgcaatatgttcgcatgggcctgttgcaacgcaataccaccagcggctcaacccagaacacagagttgacaagcttcacgtatggtctgccgacggatgcagccatgacgccgcgcacgggaaccgctgcctacaacacgcaagccttcggcgccgtcagtgcgccgggagcggagccgaaggcattccagggggccggtcaagtcgacatcgacttcgtgcaaggtgtgttcagcggccacagctacttgaccgaatacggccttgtgaatggcggcacctcttcgggcggcggcatcgaactgactacggtcggccagctttcctctaccggtgcagggctgactggcaccgctgtctacggaggctgggacggcacggtcaccgccgacctgacaggcagcctttacggtccgtcaggacaggaactgggcgcgacgttcagcggtgagaatgccaacggaatgaccgtgaccggttcaatcgtcggccagcaagacggcacgctaaccccggccaacctttcgttcgcgaacatgacccaccaacagagtttctacacccgcatgtcggaatattcgggaggtagcctgacctggcagaatagcgagacattcatttattcgggctattcctcggatgaatcgggtggtcagttcacaattgacgacaaagtggccggggcggcgaacttcacgacctatcgcaagaccttcagcaacagctactacggcacacaggacgtcacgctggagctttacaagcctggtgctgccaactccgaactggctcttacctacgccagtttcgggcactggcagggttcgctgccctccagctacgccagcggggtgaatagccagtggttcgtctatggcttcacgaccccgaactatgcccttgccaaccgaaccggctcggccagctacgaaggcgtcgcttatggcacgggctttggctccggcggtcagcgttacgacgtcaacggcacctcaaatctcgccgtcaatttcagttccgacaccttcaccggcgcgctggcactgagcggtcgcaacaccacaaccagtgatttgaccgacttcggatccacggccttctcgggcaccatcgacagccgatccaatactctgaagggcgacttcagcgcaggtgggatattgggcagcgggatctacggtcaattctacggtccgcaggggcaggaagtggcaggcaccttctcgttcaatacaccgcaaggcagcgccgcagccggagttaaccttagcggcgccttcgcggccaagcagaagtaa

SEQ ID NO: 980 - protein, 510 aa, Novosphingobium sp. Rr 2-17
MAVAWDRTTNTGISGSTKSATMTIAYNANTNGYTISTDGYSQTFLPADQTSKDDYDTVYSNNGAILTLTSKGYENNLVTQYVRMGLLQRNTTSGSTQNTELTSFTYGLPTDAAMTPRTGTAAYNTQAFGAVSAPGAEPKAFQGAGQVDIDFVQGVFSGHSYLTEYGLVNGGTSSGGGIELTTVGQLSSTGAGLTGTAVYGGWDGTVTADLTGSLYGPSGQELGATFSGENANGMTVTGSIVGQQDGTLTPANLSFANMTHQQSFYTRMSEYSGGSLTWQNSETFIYSGYSSDESGGQFTIDDKVAGAANFTTYRKTFSNSYYGTQDVTLELYKPGAANSELALTYASFGHWQGSLPSSYASGVNSQWFVYGFTTPNYALANRTGSASYEGVAYGTGFGSGGQRYDVNGTSNLAVNFSSDTFTGALALSGRNTTTSDLTDFGSTAFSGTIDSRSNTLKGDFSAGGILGSGIYGQFYGPQGQEVAGTFSFNTPQGSAAAGVNLSGAFAAKQK

SEQ ID NO: 981 - DNA, 690 bp, O. batsensis
atgatgaagaatttcaagattgtggtattggcactgtgcgcgctgccgattgcggcatgttctcccaagcctggcggaggcggaggaggaaccgcgggcaccggcaaccccggtggcacgctgagcagttcgggatatcaatcggcgctcagcgcggttcaggggcgcggcccgacatccgacatgccgaccacgatgaatgccaccttcaccggcgcgacgcggcaggatctgcgtgagaccaacggcggcgcgatcgtcggcgagatgatggccgacctcgaactgaccgccaactggaccgatggtcagagtacgaacccctggtcgggcaaggccgacaatttccgcgggtcgatgaacgggcaggactatacgctgaccggcgaactgaccgtggccgcagccgaagccaagagcctgacctccacgatcggacggagcgcgaataccattgccctgcccacgggcggcacgacgaccgtcgcgacgggcgcggccgcggtcaatcttgccggcgatgtcgatgacggcagcggcaccccgcacgaggtgatcatgtcgctcggcgggtccttcttcggtccgcagggcacggccatcagcggaccggcgacgacccagggtttccgggcgggaggggtccggtccgatctgattgccgccggcgattattacgtcgagcgataa

SEQ ID NO: 982 - protein, 229 aa, O. batsensis
MMKNFKIVVLALCALPIAACSPKPGGGGGGTAGTGNPGGTLSSSGYQSALSAVQGRGPTSDMPTTMNATFTGATRQDLRETNGGAIVGEMMADLELTANWTDGQSTNPWSGKADNFRGSMNGQDYTLTGELTVAAAEAKSLTSTIGRSANTIALPTGGTTTVATGAAAVNLAGDVDDGSGTPHEVIMSLGGSFFGPQGTAISGPATTQGFRAGGVRSDLIAAGDYYVER

SEQ ID NO: 983 - DNA, 1554 bp, P. bermudensis
atggtcatgcgtctttccaccggcctatttgccgcttcgtctctgattgccctcgcggcatgtagctcaaccggcggcacccccgaccctattttgggggaggacggacagcccgcaccgccgcgcaaccttgtcactaacgccttgagctatcgcgccgaaaaccacgggtcggcagtcagcgagacctatgatctggccgtgacggccatgcggacacgctatcaaaccaacggggcggcggtctttgtcgggatcgaacacgacgcggtgggcgagagcgagacgacagagtttagatatgatgccgccgcggacaccttcaccattgatatcgatttgccgaatgcggacgatgccccgatcctggtgaacgaaacatgggggccgctcctattattgaccccgaaggatctcttcggcctcaataacggggtgtcggcagtctatctggccaagcaacccgacttctacggcttcgtcgacgagaccttgatcggggggaacgaatttaccgccgacgcctatatcgatgcccttggcgccgtcgatgcgacgggcagcggcagcggctatctggcgctgtgggtgacgatcgccaatgaccttgggtttgaaggatcggaacgggatgtcggctccctgccgatttatatcgcgaacgatccggcaaccttcggcgcgccgggctccctcgccggggatatcgaggccgccactgcgtatgtcgaagatctcagccccgccgccttcagcgacgcccaggccgccgcccccgtccccagcagcgccttcgacccgatcatgagcgagctccttgccaccgcccccgaaagtttcggcgtcaatgttgagggacagatttccgacaatgatgcaagcttcatcattgccgtgatggacgatgtcggcggcacagcggtcgaggattacatcaccgcgatcacgatcattaccgacgacatcgaagcggcgcccaattatctctaccaagccaacggcgtcacctattatcagtataaaaccgaaggggatgtcgtcgatacccgcttcgttgccgccggggaatggcagaagaccgaagccagcggcgagaccattttcggtcatttcgtctacggtcaattgaccgatcccgatgagatgccgacctccggcaccgccagctacacaggcacggtttacggctccatcctgcggcaaaaccgggtcgacagcctgcgcggcgggctcaacctgaacaccgattttcagaccggcgccctcgacatgaccttcaacgccgatatcgcttaccgcgacgatgaggggataacccaatttatcgactatgccgacttcaccggcaccggccggatcgacgatgccaatttcgatggcaccatgcagggggtgacctcgatcgatacctctgaaaccgacagcccccttgtggtggacgggtccttcgaaggccatttctatggccccaccgcccaagaggccgggggcaccttcgaattctcgaacaccgaggccgcggcgaccggatccttcgtcgctgtcagggattaa

SEQ ID NO: 984 - protein, 517 aa, P. bermudensis
MVMRLSTGLFAASSLIALAACSSTGGTPDPILGEDGQPAPPRNLVTNALSYRAENHGSAVSETYDLAVTAMRTRYQTNGAAVFVGIEHDAVGESETTEFRYDAAADTFTIDIDLPNADDAPILVNETWGPLLLLTPKDLFGLNNGVSAVYLAKQPDFYGFVDETLIGGNEFTADAYIDALGAVDATGSGSGYLALWVTIANDLGFEGSERDVGSLPIYIANDPATFGAPGSLAGDIEAATAYVEDLSPAAFSDAQAAAPVPSSAFDPIMSELLATAPESFGVNVEGQISDNDASFIIAVMDDVGGTAVEDYITAITIITDDIEAAPNYLYQANGVTYYQYKTEGDVVDTRFVAAGEWQKTEASGETIFGHFVYGQLTDPDEMPTSGTASYTGTVYGSILRQNRVDSLRGGLNLNTDFQTGALDMTFNADIAYRDDEGITQFIDYADFTGTGRIDDANFDGTMQGVTSIDTSETDSPLVVDGSFEGHFYGPTAQEAGGTFEFSNTEAAATGSFVAVRD

SEQ ID NO: 985 - DNA, 606 bp, P. bettyae
atgaaaaaactatttctttgctcaattgtgagtttatccatcctattgactgcttgtagtggtggtggcggtagcggtagtgcacaaactccagatgctagcaaaatagatttaactaacagtccaaaaggtgatgtggcagttaatacggcggcaggaaccttatatggaaaaaatcaaaatgactctttttatggtgtatggatggatgatgctaagacagtaaaagaattacgctatcaaggtacatcagcaactaatttaccttctggttctgcaacttatacaggagaatcatattgggttagtggcacaacgggtgagatatcaaagggtggtgttagcactttaaatgttgattttgatcgaaaagcagtagatggaaaaatcacgtattcacttttaaatgatggtagagttcaagatattacgctacattctacagcattggatggtacaaaatttaatggtaatgcaagtaccttattagaaagtggtagttatgaaggtgcattatttggtaatggagctaaagaagccgctggaatagtgaatttcccaaacaatagttcttataacacatcatttggtggtgttagatattaa

SEQ ID NO: 986 - protein, 201 aa, P. bettyae
MKKLFLCSIVSLSILLTACSGGGGSGSAQTPDASKIDLTNSPKGDVAVNTAAGTLYGKNQNDSFYGVWMDDAKTVKELRYQGTSATNLPSGSATYTGESYWVSGTTGEISKGGVSTLNVDFDRKAVDGKITYSLLNDGRVQDITLHSTALDGTKFNGNASTLLESGSYEGALFGNGAKEAAGIVNFPNNSSYNTSFGGVRY

SEQ ID NO: 987 - DNA, 1035 bp, P. dagmatis
atgaaagagttagttatcaaaaccagcttatttatcggattatctagcttacttgtagcttgtggcggtggctcagatacgaatgctgaaagtagtcatgaagcacagcaagttaacccaactgcagtaaactctcaaccacaggttgaacctaaaacacataatgaaacccaacctgaaaaacaactagaaaaagaacaaccgcaagatcgagaagataaaaaccaactgcaaccagaacagcctaaaaatcaaaatacgcgagaagataaacctgcacacactccctcaagtcaacctgctgtcgttaaagtatatgcggatagcgatataaatacagaatggtttggaatgaaaacctctaaatatcattctcctacagtgattaacgaaaataggaataatgtagaaatatatgatttagtgttagtggaaaatccagatgatcaaaccaaatatgataaaactaaatctaaacaaactacgatcgcattgcgtaaagaaggagaaactagtcattatagtcatggaaaacttaattattcattcgatttagtaaatggcaatatatattatggctattatttaaaaccagaagctgattataaaaactcatatcttacatactcatatgcttttgataagagtatagaagacaaccgctccttagcaaactactctgctaagtactcacaatatggtggattttcattctctgtaaaaataggaaatgattatatacaacaatttggagatgtggacttaatctacacaaatggaagaattagtggtgaaatcacaaatccacatagcagtgaagttaataacaaaatttttgatttagaaggaaaagaaagagaattaatcattagaccaaataaagataatgaatataagctaagttcaaacggtggagataatatgtccatgcaactacaccttattaattctaatcaaaaagaatacattataggggcaggtaaagccgaaaattattatggtgtacttttcgcagaaaaaaaagaaaatgaataa

SEQ ID NO: 988 - protein, 344 aa, P. dagmatis
MKELVIKTSLFIGLSSLLVACGGGSDTNAESSHEAQQVNPTAVNSQPQVEPKTHNETQPEKQLEKEQPQDREDKNQLQPEQPKNQNTREDKPAHTPSSQPAVVKVYADSDINTEWFGMKTSKYHSPTVINENRNNVEIYDLVLVENPDDQTKYDKTKSKQTTIALRKEGETSHYSHGKLNYSFDLVNGNIYYGYYLKPEADYKNSYLTYSYAFDKSIEDNRSLANYSAKYSQYGGFSFSVKIGNDYIQQFGDVDLIYTNGRISGEITNPHSSEVNNKIFDLEGKERELIIRPNKDNEYKLSSNGGDNMSMQLHLINSNQKEYIIGAGKAENYYGVLFAEKKENE

SEQ ID NO: 989 - DNA, 711 bp, P. galatheae
atgaaaaaagctgtcatcactcttgctgttctttctgcctgcatcagcggcgctgcccaggccaatattgtcggcacccaaagtgacaacactcagattctggtgggagaatcgaatctgaatgccgggccgcatgtcgcaggtcgtgcaggtattggggctgcatcgatgggttccaccgcgcaaaaagttgattttcaggccctgaaaaattatggccgcgtgcaaaacggcgtttatgtgctgggtggcggccactcaaggatgggcaacttcaactttgccaaagtcggggctggtgatgtctggttcggggagtgggcgagtgatatcagcagtgatgccgatcggacggtttattacgtgggcgataccacgggtaccacactaccgaccagcggcacggcgacctatgcggtgaaaggggtgaacaagttctctggcagcaatgacctgaatgggactttcacagcgaacttcaccaacaatacgttgcaaggttcgattgccaacagccagtatacgctgggggtgaatgcgaccatcaacagtgccaccgctgcctttaacgggacagccacggtcggcccagccagcggcacagcaaaaggtcatttctttggcaatcatgcagcggcattggcggggattgcacaattttcaggggatgcaaaaatcttcgacaccgctttcggcggaaccaagcagtaa

SEQ ID NO: 990 - protein, 236 aa, P. galatheae
MKKAVITLAVLSACISGAAQANIVGTQSDNTQILVGESNLNAGPHVAGRAGIGAASMGSTAQKVDFQALKNYGRVQNGVYVLGGGHSRMGNFNFAKVGAGDVWFGEWASDISSDADRTVYYVGDTTGTTLPTSGTATYAVKGVNKFSGSNDLNGTFTANFTNNTLQGSIANSQYTLGVNATINSATAAFNGTATVGPASGTAKGHFFGNHAAALAGIAQFSGDAKIFDTAFGGTKQ

SEQ ID NO: 991 - DNA, 963 bp, P. halotolerans
atgcacagatatgctccgttttttcttattggactttcaggcacgcttttggcgggctgctcttcgaccggcgggggtggtgcaggcggcgggggcggcggggggacgccctcgccggcactgtttgccgcatcggcgggcacggcgagcgaggctttggcggatggggagacgctgatggcgtataacagcctgatgagcgctgccgtcgagcacgatttcgacgcgggcgagacgcgggcgctcgatggcaccacgttttcgattgccgccaatgaccagggcggcctcgatgtgatcatcgacggcgttgcctacagctttaccgacgcggacatcagcgggaatgccttcgagttcgacgatcccggcggaatggggccctattaccggctcaacagttgggacggggatatcgtggatgtgctcgatgtgtccaacaccgcccatcaccaggtgtggagctatttctgggatcccgcaggcgagccgatcagcggctttgcggtggtgggcaccgaaaccatgccggaggctctggagggcaaggccaatgccacatattcgggcgcggcgggtgcggcgctgaccgacagcggcaccttcaacgacaccacgcgcatcgtgggcgagctggcgatgtcggcggatttcaacgccggccagatatcggggcttgtcgacaatatcgcggtgatcggtcttggggcgtgcagcggcggcgtgggtcccgcatgcgtcaacggcactgccgccctcgacagcgcggcaatcacggggacggggttcagcggaaccatcaccgccgacagcgaccttctgacggcgttttcgctcaccgatctgggcggcacctatagcggcaagttctacggtgcggacggtgaggaggtgggcggcgtcatggcgctgagcggcgaggaaacggtaggtactggctatttctcggccacccaggactga

SEQ ID NO: 992 - protein, 320 aa, P. halotolerans
MHRYAPFFLIGLSGTLLAGCSSTGGGGAGGGGGGGTPSPALFAASAGTASEALADGETLMAYNSLMSAAVEHDFDAGETRALDGTTFSIAANDQGGLDVIIDGVAYSFTDADISGNAFEFDDPGGMGPYYRLNSWDGDIVDVLDVSNTAHHQVWSYFWDPAGEPISGFAVVGTETMPEALEGKANATYSGAAGAALTDSGTFNDTTRIVGELAMSADFNAGQISGLVDNIAVIGLGACSGGVGPACVNGTAALDSAAITGTGFSGTITADSDLLTAFSLTDLGGTYSGKFYGADGEEVGGVMALSGEETVGTGYFSATQD

SEQ ID NO: 993 - DNA, 805 bp, P. luminescens
aggaatatgctatgaacaaagttaaagtgttaattgcagtattaggtacatgtgggttagtaacacaagctatagcggccccaggttttgggcaaactcaaaagtttgatgagaataaacctagcgttaacgtaggggtgactgaaccacgtggtggtggtcacccaaccttaggtggagagccggggattggggtgcaatctatttctaatggtaggattattagcttttcaagccttgctgcttatgtcaaggcggatacaaatggaattcataaaatttctatgcctggatcgggtagtcatggaggcatgggggtattcaactttagtaaagtggctgatgctgatgtctattttggtgaatggtcacaaaccggtaaggtgaatgatactactcatactgcctattattccggtaaagatgtcacgactaatttgcctaccggtggtattgcaacttatacggttaaaggaattaaccaatatagtggtagcaatgctctacatggaacatttactgctgatttcggtcagaaaagacttactggttcaatagcaaatagcgcactcactgtcggtattaattctgttattaaatctgatggctcatttgttggtagtgcgactgctggaggtgctgttggtagaaatagcggacatttctttggtgataatgccgctagtttagcagggactgctacgtttgctgcggaccatagtaaagataccgcctttggtggaactaagaacccgtaatatgcgttcttagtaactggataaggcaaagccatgtgggctttgtc

SEQ ID NO: 994 - protein, 248 aa, P. luminescens
MNKVKVLIAVLGTCGLVTQAIAAPGFGQTQKFDENKPSVNVGVTEPRGGGHPTLGGEPGIGVQSISNGRIISFSSLAAYVKADTNGIHKISMPGSGSHGGMGVFNFSKVADADVYFGEWSQTGKVNDTTHTAYYSGKDVTTNLPTGGIATYTVKGINQYSGSNALHGTFTADFGQKRLTGSIANSALTVGINSVIKSDGSFVGSATAGGAVGRNSGHFFGDNAASLAGTATFAADHSKDTAFGGTKNP

SEQ ID NO: 995 - DNA, 801 bp, P. mirabilis
atgaaaaaaataaacatttttacgggtactctatttgttttatctagcataagtatggcacaagcagaaatccattctaatcaaagtggccctttaaccaccatgagtgtgggggcgagtgatcccgtgactcatggccctcatcaatcagcaggtggggagccgggtgttggtatttctaatctatatgggggtaaaaaaattggttttgcgtcattaacaccaaataatatgagtggtggggcggatagccatggtgtttatactgtccaatctaatcatcatcataataatcttggcgtttttcatttttcacaggtgactgatgccaatgtctattttggtacttgggcaaaaacagcctctgttacagatatcactcatcagtcttattatgtaggtaaagaggttactagtacgctaccgacagacagtgcaacttataccgtaacaggtatcagtcaatatagtggtgataatttactgtctggtacttttgatgttgatttttcacaaaagacaattggtggttcactggctaatagcctacgtactgtcgagttagaacgtggcaatatttataccgcaaataaccaagtaactttctctgcagatgcaaaagaagataccacatccggtattgttgaaggggcgttctttggtgaaaatgctgaaacattggctggtattgtcgtcttccacaccgatcatactaaagatattggttttggaggaagcaaaaatagtgctgaagtagatactgcaacagatagcgtaacagatagtgcagaagcctcttaa

SEQ ID NO: 996 - protein, 266 aa, P. mirabilis
MKKINIFTGTLFVLSSISMAQAEIHSNQSGPLTTMSVGASDPVTHGPHQSAGGEPGVGISNLYGGKKIGFASLTPNNMSGGADSHGVYTVQSNHHHNNLGVFHFSQVTDANVYFGTWAKTASVTDITHQSYYVGKEVTSTLPTDSATYTVTGISQYSGDNLLSGTFDVDFSQKTIGGSLANSLRTVELERGNIYTANNQVTFSADAKEDTTSGIVEGAFFGENAETLAGIVVFHTDHTKDIGFGGSKNSAEVDTATDSVTDSAEAS

SEQ ID NO: 997 - DNA, 942 bp, P. multocida
atgcagtattttgacatcaaaaaatctctccctgttttttgttctcttctgattaccgcttgtagtggtggtgggggtggtaataatccatcacaatatcctaaagaagtacgccctgtggtaactgaacaagccaaaacagctaaagaagtgattttacctacaccctctattggatcagaacagtcatctcaaaacgtaatagctaaagatgctttcaatgtgagcgaaaaaacgcatcaacactccaaaccagaaaaaattgcaaaagatattaattggacaggtagtgctgtgtcgtctataggctctacttggtggcaacataaaccaaataatattcctgtttttacactaattcttaatgaaaaccaaatttactccgatgaaaaaaacttcactctagaacaaaaacatattgatcttacaaagaataatattttggatgaaaagtactttcatttcacattattagactccggaatttattatggaaattatttaagttcatacgatcagatgaacgcagaatctaattatgtttttgcatttgataaagatcgtgaatatacaggaaaagatatcaccgcaaattattatggtaatgaaggatttaaatattctgtaaaattaggtaatacatacctatcacaggtgggtgatgttcacttaatctatcgagaagggaaagtatcaggagaaatttttggtcaaaataacgtaaaacactttagctttatgaatagcaataaaattgacccaaatagcattgttattgtcccagaagaagcacatcgatatctatccagaaatgataaaatgttcttagaaatgcatttcattaatggggaaaatggagaaaaatataaatatattgtgggtagtggtaaaacggacaaatactacggcgcattatttgcaactaaacaagaaaaccagtga

SEQ ID NO: 998 - protein, 313 aa, P. multocida
MQYFDIKKSLPVFCSLLITACSGGGGGNNPSQYPKEVRPVVTEQAKTAKEVILPTPSIGSEQSSQNVIAKDAFNVSEKTHQHSKPEKIAKDINWTGSAVSSIGSTWWQHKPNNIPVFTLILNENQIYSDEKNFTLEQKHIDLTKNNILDEKYFHFTLLDSGIYYGNYLSSYDQMNAESNYVFAFDKDREYTGKDITANYYGNEGFKYSVKLGNTYLSQVGDVHLIYREGKVSGEIFGQNNVKHFSFMNSNKIDPNSIVIVPEEAHRYLSRNDKMFLEMHFINGENGEKYKYIVGSGKTDKYYGALFATKQENQ

SEQ ID NO: 999 - DNA, 1074 bp, P. pneumotropica
atggaactaacaaaaatttcattgacaagatttggtttaactgccctggctgcgttaattgtttcagcttgtggaagtagcggcggtggcagcagtagtgataatcagccgcaacaaaataatgcgtcaaacaattctcaaataagtcaacaaacaaacaaaacatctgataataaaacatctgataacaaaacatctgataacaaaacatctgataacaaaacatctgataacaaaacatctgataacaaaacatctgataacaaaacgtctgataacaaaacgtctgataacaaaacgtctgataacaaaacgtctgataacaaaacgtctgataacaaaacgtctgataacaaaacgtctgataacaaaacgactgataacaaaacatctgataacaaaacatctaacaatcaactccaacaggagagaaacggaacaggtacggcaattgtaatatcaggaagtaatgataatgttaatgcacaaacctcaacattaaatcattacaacacaacctctataaatatagatggagtcgatattatcattggattgcaagatcttgatattcaagattggacgcttacgggcttcaggggaagaaaacttgaagtatgttgcggtcgctattcggatatccgctttggtgtgagtgattctttaaatgaaagtagcaatggctatatgttctacaatggaaatccaactcaaaatatgccaacatcaggtaccgcaacttattccggtgatgcgattatttctgcagaaaacatttatggactagatccaaaagactactaccgtggctcatctaaatttaatgtcaattttggaaataaaaccttagaaggttcactcagtatcccaaatgggaatcgccaacctgtaaaagtagaaattaatgccaaaatttcaagtaatgcatttacaggtacaacaaattcaaccacactacaggatggtcaagtagaaggtaaattctatggcagtaatgcaaaagagatggccggtcttgcacaaggtaacgataaatcttggggtgccgcttttggtgcagcaaaacaacaataa

SEQ ID NO: 1000 - protein, 364 aa, P. pneumotropica
MNCTRYLMELTKISLTRFGLTALAALIVSACGSSGGGSSSDNQPQQNNASNNSQISQQTNKTSDNKTSDNKTSDNKTSDNKTSDNKTSDNKTSDNKTSDNKTSDNKTSDNKTSDNKTSDNKTSDNKTSDNKTTDNKTSDNKTSNNQLQQERNGTGTAIVISGSNDNVNAQTSTLNHYNTTSINIDGVDIIIGLQDLDIQDWTLTGFRGRKLEVCCGRYSDIRFGVSDSLNESSNGYMFYNGNPTQNMPTSGTATYSGDAIISAENIYGLDPKDYYRGSSKFNVNFGNKTLEGSLSIPNGNRQPVKVEINAKISSNAFTGTTNSTTLQDGQVEGKFYGSNAKEMAGLAQGNDKSWGAAFGAAKQQ

SEQ ID NO: 1001 - DNA, 747 bp, P. rettgeri
atgaaaaagttaaatattatcgctctagcactcgcaacctgcacagtaacttttggtgcttctgcagcaatcggttctggccaaagccaacctttcgatgctaatcagccttccgtccgtgttggtgcaacagaaggaaccggtggtggtcatggtggtgctgcgggtgacccaggtattggtgtgcaatctgtttatggtggaaaaaccatttctttctcaggcttaactcgaatggcaccaatacaggcaggaaatgaagcacatgttatttccatgcctaatggacctggttcacatgacaaaatgggcgtttttaactttgccaaaattgcagatgcagaagtctacttcggcgaatggtcatcgacaggacaagttagtgacaccacacataccgcttactattctggcaaggatgtcaccaccaatatgcctacagctggcacagcggaatactccgttaaaggaataagccaatacaatggaggcgcactaaccgcagggactctgacagccaactttggtactaaatccttagcagggaatattggtgcaaccaatattgatgccaccattaaaaacaatgccactttcgccggggcggccactcttaatggtgaatcaggctcaacaaatggacacttctttggcgatcaagctaagcatattgctggtgtcactcaatttgaagatcacagcaaagatatggcctttggtggaagccgtgggaatatttcccagtaa

SEQ ID NO: 1002 - protein, 248 aa, P. rettgeri
MKKLNIIALALATCTVTFGASAAIGSGQSQPFDANQPSVRVGATEGTGGGHGGAAGDPGIGVQSVYGGKTISFSGLTRMAPIQAGNEAHVISMPNGPGSHDKMGVFNFAKIADAEVYFGEWSSTGQVSDTTHTAYYSGKDVTTNMPTAGTAEYSVKGISQYNGGALTAGTLTANFGTKSLAGNIGATNIDATIKNNATFAGAATLNGESGSTNGHFFGDQAKHIAGVTQFEDHSKDMAFGGSRGNISQ

SEQ ID NO: 1003 - DNA, 753 bp, P. sneebia
atgaaaggattcaatattattgccttagttatagcatcttgcggtatgtctttagcaacaaacgcaattgccagtgtaggatcaagtaaaagccaaatagctaaaaactctgacttaagaattggtgaaacagctaaaaatcaaggcgctcacaaaggtcctgctggtgaacctggtattggtgtaaaaagtattaaaaatggaaagttaatttcatttgcgggtttaacacgtatggcaccagcaaatactgacgatgttcatgtcatttccatgccaaattcacctaatgcgcctaaatcacaccgtaatatgggtgtatttaattttgctcaagttgcagatgcagaagtttactttggtgaatggtcacaaacaggtgagataacggatatatctcatacttcttactattcaggtaaagatattacaaccaatatgccaacaggcggtacagcaacatatagcatcaaaggcataaatcaatatgcaggaggacctttattacaagggcatttaaatgctgatttcggtgcaaaaacactaaaagggaatatcgatgctgtcagtattaatgcaaaaattaaagataatgcgacatttagagggttagctgaaatcggcgaacttcaaggtaaagcaaaagggcatttctttggtgaccaagctaaacatatttcaggtattactcaatttagcgatcacagtaaagacatcgcctttgggggtagccgtggtgatattcaaaattaa

SEQ ID NO: 1004 - protein, 250 aa, P. sneebia
MKGFNIIALVIASCGMSLATNAIASVGSSKSQIAKNSDLRIGETAKNQGAHKGPAGEPGIGVKSIKNGKLISFAGLTRMAPANTDDVHVISMPNSPNAPKSHRNMGVFNFAQVADAEVYFGEWSQTGEITDISHTSYYSGKDITTNMPTGGTATYSIKGINQYAGGPLLQGHLNADFGAKTLKGNIDAVSINAKIKDNATFRGLAEIGELQGKAKGHFFGDQAKHISGITQFSDHSKDIAFGGSRGDIQN

SEQ ID NO: 1005 - DNA, 747 bp, Photorhabdus temperata J3
atgaacaaagttaaagtgttaattgcagtattaggtacatgtggattagtaacacaagcaatagctgcgcctggttctggacaaacccaaagttttaatcctgagaatcaaagtattacagtcggtgtaactgaaccgcgtggtggtggtcatccgaccccaggtggggagcctggaattggagtgcaatctgttgctagaggtcaaattaccagctttgcaagtcttgctcgttatgtcgaggcggatgcgaatggcattcataagatttctgtgcctggatcgagtagccataaaggcatgggggtatttaactttagcaaagtggctaatgctgatgtctattttggtgaatggtcacaaaccggtcaggtgcatgatactacgcacaccgcctattactccggtaaagatgttacaaccaatttaccaactggtggcatagcgacctatacagttaaagggattaaccaatatagtggcagcaatgctctgcaagggacattcactgctgatttcggccagaaaagactttctggttcaatagcgaatagcgcattgactgttgatattaattccagaattagagcagatggctcatttgtgggtagggcaaccgctggaaatgttgtcggtacaaacaacggccacttctttggtgataatgcgtcgagtttagctggggtggctaaatttaattcggatcatagtaaagataccgcctttggtgggactaagaatccatga

SEQ ID NO: 1006 - protein, 248 aa, Photorhabdus temperata J3
MNKVKVLIAVLGTCGLVTQAIAAPGSGQTQSFNPENQSITVGVTEPRGGGHPTPGGEPGIGVQSVARGQITSFASLARYVEADANGIHKISVPGSSSHKGMGVFNFSKVANADVYFGEWSQTGQVHDTTHTAYYSGKDVTTNLPTGGIATYTVKGINQYSGSNALQGTFTADFGQKRLSGSIANSALTVDINSRIRADGSFVGRATAGNVVGTNNGHFFGDNASSLAGVAKFNSDHSKDTAFGGTKNP

SEQ ID NO: 1007 - DNA, 930 bp, Phyllobacterium sp. YR531
atggctgtgaaattgctttttgtcgctggcctctgcgcgactctggtcggatgtggccattcttcagagaaaactgtttccacatcgtcagctggcagcgaacccgtttccgtacagcccactgtcgcaaaaccagagtcgacaaaatccgtagcagaatatgaccttaaaggtcatggttttgtgacaggagctgatggaaagttggtggcggtcaatgttggtgccaaggtcagcggtctatcggaaacagagtctgctatgtttaaaggcaatacgcctctggtaaagctggcttatagtggtgataagccatttacgggtacaaccacggggacgcggcgcgacagcggtgaggactatgggccttatggcaatgatacccgttttctcatgagtgatacatctatcaattccaaggatgcgccgacggcatttggtgtgttccgcgaccaatccagtaaagacaagtttaatgcagctgcttattatggtggcgtgaatgcaacgaatgtgcccacttccggtcaggctagctatcgtggcaagtttgccggcgggattaatgagagcggcgttgtgggcggcgagcaaaggcacgtttctggaaagtttaatctcgctgctgactttggagcaggtaccgtcaagggcactgtgtccgagcttaatgccacccatcgagatcctataatagcggccggtaacctcaatgcaaccgacctgacattcgacggtacaatagccaaggacaagccaacctactcagcagataaggtcactttcgagggcgaaaccctcgcagctaatgttgagggcggtttctacaatgccaatgcaagcgagacagctggtattatcagcgccacgaccgatgctgaagacacctcaacaataattggtacgttccatggtgaaaagcaaccgtag

SEQ ID NO: 1008 - protein, 309 aa, Phyllobacterium sp. YR531
MAVKLLFVAGLCATLVGCGHSSEKTVSTSSAGSEPVSVQPTVAKPESTKSVAEYDLKGHGFVTGADGKLVAVNVGAKVSGLSETESAMFKGNTPLVKLAYSGDKPFTGTTTGTRRDSGEDYGPYGNDTRFLMSDTSINSKDAPTAFGVFRDQSSKDKFNAAAYYGGVNATNVPTSGQASYRGKFAGGINESGVVGGEQRHVSGKFNLAADFGAGTVKGTVSELNATHRDPIIAAGNLNATDLTFDGTIAKDKPTYSADKVTFEGETLAANVEGGFYNANASETAGIISATTDAEDTSTIIGTFHGEKQP

SEQ ID NO: 1009 - DNA, 1449 bp, Psychrobacter sp. 1501(2011)
atggatatgaaatttaagtatttaacattagcattagctgcagcaatggctactacaggtctaactgcttgtggaggtgacgataatagtaattattctgatcctgtaactgatcctgtagatgaaacagaccctactgatcctgtagatgcaacagaccctactgatcctacggataatgcaggtgatgcagctgaagcatttgatatttctaaaaaatcatctgtagtgggtcaaaattatatccgtggcagtagttctgattttgataaatcaccagatacaaatgtaaaaggcactgataatggtaactctacagtattaggcgctgagacactgcaaaacaaaaaaatgaccaacattgttgttgctcagtatgacgatgtttctgttactgatgctgaaggcaatgctaacaacgttaaatatatcttgggtgaaaaaccaaaagctaccccagatgtaaatgctctagactctatccaaactaataatgatgcaagtcatgctagtggaacactttctccatttataatggttactaaagatatagacgataaatttgtatcaacaggtcaagagtctaaagtagattctaaaaactctaagttcactcagactggaacggcatttgttgcttctacagacactgataatgatgcaagagtttacggtaaactttctaataaaaacaacaccttaaacaacagttcaagatatatttacaatgatacaaacactgtagatttaggtactaatagtcagtttaaagttacccctattaaacttaatcatgttcaatatggtcgagttacgggtaatttagaaggcgtaacagcagataccatcgctggtcgcagctatatccaagcagatttcgccaataagaactttaatggcaataccactcaaacggatatctacttctaccgtggcttaagtcaaactgccattgctgctatgcctaaatcaggtaccttcgagtacgctggacatgccttaatgtacggtatcgataatagctataccggtgaagatgccaatggtcaatctaactcagttgcttttggcgcaaatgctgaagcaataggtaactttgtaaatgcgacttatgatgctgataacaaaactgtagacggttcgatttacaatgtatggaatatggatactgacaaaactgaagttaaaagtgtaagtttagttgcatttggcggtgacgttatcggtaatactattaaaggtaatgccaatctaacttatgatgaggctaatactgcatcatttaaaggtagtttctacggtcataacgctaaagaaatgggtggttcattcaactcaattagtgataagtatggtaaagcggagtggggtggtgttttcggagctaagcaaattgataaacctgctactggccctgtgttcattccaccaatcaatgctgttgaataa

SEQ ID NO: 1010 - protein, 482 aa, Psychrobacter sp. 1501(2011)
MDMKFKYLTLALAAAMATTGLTACGGDDNSNYSDPVTDPVDETDPTDPVDATDPTDPTDNAGDAAEAFDISKKSSVVGQNYIRGSSSDFDKSPDTNVKGTDNGNSTVLGAETLQNKKMTNIVVAQYDDVSVTDAEGNANNVKYILGEKPKATPDVNALDSIQTNNDASHASGTLSPFIMVTKDIDDKFVSTGQESKVDSKNSKFTQTGTAFVASTDTDNDARVYGKLSNKNNTLNNSSRYIYNDTNTVDLGTNSQFKVTPIKLNHVQYGRVTGNLEGVTADTIAGRSYIQADFANKNFNGNTTQTDIYFYRGLSQTAIAAMPKSGTFEYAGHALMYGIDNSYTGEDANGQSNSVAFGANAEAIGNFVNATYDADNKTVDGSIYNVWNMDTDKTEVKSVSLVAFGGDVIGNTIKGNANLTYDEANTASFKGSFYGHNAKEMGGSFNSISDKYGKAEWGGVFGAKQIDKPATGPVFIPPINAVE

SEQ ID NO: 1011 - DNA, 2823 bp, Psychrobacter sp. PRwf-1
atgtcacttcactgtcattcaaatttggttgtgtcttcagctaaaaaactgaatacccctttaaaaccaagcgttgtcttattaacctcttttattttcgcttcagtatcagcctatgcaggcacaagtactaagcaaaacacacctaccaatcctgatgttgctgctcaatctaatttaacaggagtccagagcaacgccattggcaagtctggtctaggtaccagtattcgctacactgaaattttagataatgagtctgatagttacaatcagctagccgttcgagctgatcaagttgcttcaaaaatggccaagcagggtcctattgatattcaactaacggatctaaatgacagtgatttggagaatggctttaagcagcattctggatttactgaagtcgtgggacaagactcggcaggtatcgctccacgaaaacgccgtatggattacaccaccacctacaagaacttcgatgatcaaatgcaaattggtcatgttcatggtgacctaaaagctccgctaataaacgtcgatgaatatcgtttatcgaatgtctacgtacaagggaatgccacagatgaggcagatattgagttcttacaaggctgggcgcagcatcatcaagacaccaatctaagtgaaggagtggttcagtacacaggtgatgcgacctatatggagaatttacatcttaaggatggtcagcaaagtagccctgttgtgaatggtacctctgaatttaacgttgattttgtcaaagctttgcttgaagggacgcttagtttccaagatggtgactacaagtatatgcctgaaggcaataaaatcggtattaaagcgggtataaccggcaatacttttaaaggcaataataatggtattgataccgcaggtagcttctatggagaagatggtcgtctgttgggcggtatttatcagcaagcgttaacacctggaggagagggtagtgcaccaggtgagggaaccacgttccaaggcacctttggcgcaagtaaaactactaagacgctcgaccctgtagccaatcctgatgttgcagttgattcgaatgttacgggctttcacagcagtgcattaagtaatgataacttaatcggcccaagcatacactacggtgctattcgtgataataagacaggcagttatgatcagttgtctattcgagctaatgaaactgattcacgagaatactatgcagcagtgggtgtgaacttaacgggtagtgaagacgccagctatggcaacggctttaagcagcatacagatgagacattgattgagctcggaccaattttaagaagagattttgaatatcagtctatctataaagatttcgatggcgaaatgcaaattggtcatgtcttaggggatcctaaagttcgctggacaatcatcactccaggtcgcttgtctaacgtccatgttcaaggtaatgctaccaaccttacggacatgcagtacatgaaagatttggctcaatataaggtagacagtgagcttaatgacggtaaggttgagtataagggtgttgccacttatatggagaacctgcacttaaaagatgggaagcgtgctggacctgtagttgatggtacctctacatttgatgttgattttatcaatgccaatcttgaaggggagctagcgtttaatgctggtgactataagtatatgccagaaggcaataagatcaagattaaagcggatattactggtaatacctttgctggtaatctaaataatattgatactgcaggcggtttttatggtgaggatgctaagcttttgggcggagtttatcaacaagctctaaccacaggtggagtcgctaagaaaaagggtgaggggacgacattccaagggacgtttggcgccagtaaagtagagactaggggctcgaacgcaccaagtgagccagagctgcctacggttgagtcggatatgacgggcttccagtctacgacgctaagtagcaaggaaaaaacactaccgtttggcctaggtaaactcgataatgctgtgggttatgtggctattcgtgatgatcagtctgacttcaccactacagtagataaagatggtagtttagtaccagtagataatcgtaaaggcgacaatttcaagagctttgataaaggcgtggtacgtgctgatatggtgaagcctgactcggtgcttaagcctattgacgtatcactaaagcaatcaggtagtgtgaaggttgatgctggaaaaggtagttttaaccctacatttaattataaatctgtttacgaaaactttgacagtcaaatgcaagtaggtcacgtttacggtaactttgactctgctgcaggagaggtatctcgagctactaacgtctatgtccaggggtacttaactgctacagaggcaatggataggttgaaagatatcaatgaaggtaaggctcagtatacaggagtagcgacctatatcgaaaatatccatttaggagataatgcaaatacagctcctgtgaaaggcacatcagccttcgatgttgactttgtgaataactcagtgaaaggtgagcttgcctttgacggtaacttcaaatatatgccagaaggtaataagattggtattgaagcgaccatcgatggtaatacctttgcaggtaatgttaatggtatcgatactgctggtggcttctatggtgaagatgctaaattcttaggtggtatctatcaagatgcggcaatcgaaggtggtaaaggcgacttacctggtacaggaactcgtttccaaggtacattcgcagctgaaaaacagtaa

SEQ ID NO: 1012 - protein, 940 aa, Psychrobacter sp. PRwf-1
MSLHCHSNLVVSSAKKLNTPLKPSVVLLTSFIFASVSAYAGTSTKQNTPTNPDVAAQSNLTGVQSNAIGKSGLGTSIRYTEILDNESDSYNQLAVRADQVASKMAKQGPIDIQLTDLNDSDLENGFKQHSGFTEVVGQDSAGIAPRKRRMDYTTTYKNFDDQMQIGHVHGDLKAPLINVDEYRLSNVYVQGNATDEADIEFLQGWAQHHQDTNLSEGVVQYTGDATYMENLHLKDGQQSSPVVNGTSEFNVDFVKALLEGTLSFQDGDYKYMPEGNKIGIKAGITGNTFKGNNNGIDTAGSFYGEDGRLLGGIYQQALTPGGEGSAPGEGTTFQGTFGASKTTKTLDPVANPDVAVDSNVTGFHSSALSNDNLIGPSIHYGAIRDNKTGSYDQLSIRANETDSREYYAAVGVNLTGSEDASYGNGFKQHTDETLIELGPILRRDFEYQSIYKDFDGEMQIGHVLGDPKVRWTIITPGRLSNVHVQGNATNLTDMQYMKDLAQYKVDSELNDGKVEYKGVATYMENLHLKDGKRAGPVVDGTSTFDVDFINANLEGELAFNAGDYKYMPEGNKIKIKADITGNTFAGNLNNIDTAGGFYGEDAKLLGGVYQQALTTGGVAKKKGEGTTFQGTFGASKVETRGSNAPSEPELPTVESDMTGFQSTTLSSKEKTLPFGLGKLDNAVGYVAIRDDQSDFTTTVDKDGSLVPVDNRKGDNFKSFDKGVVRADMVKPDSVLKPIDVSLKQSGSVKVDAGKGSFNPTFNYKSVYENFDSQMQVGHVYGNFDSAAGEVSRATNVYVQGYLTATEAMDRLKDINEGKAQYTGVATYIENIHLGDNANTAPVKGTSAFDVDFVNNSVKGELAFDGNFKYMPEGNKIGIEATIDGNTFAGNVNGIDTAGGFYGEDAKFLGGIYQDAAIEGGKGDLPGTGTRFQGTFAAEKQ

SEQ ID NO: 1013 - DNA, 9678 bp, Psychrobacter sp. PRwf-1
gtggctaaagaaaaagtggctcaagaggctattgccgcagctgaagctaaacaaaaagctgctcaggatattatagatgctgcacaaaatgccaaagataatgcccagattaataatgcccctgaatcagcgaagagtggtgtacagaccttaaacgtagacgttgtaccacttggtaaagtctttaaaacaaccacacgcgactttgaagcagatagcactagcgttgttgcccgagctgatctggcctcagaatcagcaccaggcgcaggtgatggcttattaggccaagtaccagtgacaatttcaggcgataatgatgcagatattgctggtaccaatggcttcaaagcgcatgaagataccgcagaagttgatgctttaggcaacaaactgccattaacttatacctcaacgtataaggacttcggcgatgacatgcgcattggccacattgatggtaaagcggtgtttagtggtcttgaattgccagtaaatggtgcagcggttattggtaacgcgaccaaagctgagaacatgccaaccgaaggtacagtaggttataccggtgatgcgacccatcgtaagttaggtcttggtaacgccattgaatttggttcatctgtatttaccgcagactttgtgaaaaaagcactagatggcaaactaagctttgccaaagcgggtgatattaatcttaaagcgaacatcagcggcaataagttttcaggtggcgcagcagacaacgcaggctacgcaactgaaggtggtttctacggtggtgacgcccagtacctaggtggtgtgtatgaaggtaatggtgctcaaggtacttatggtgcgaaatctgacaagcaaactgcagcagaacaagcagccgtagacgcacaagcagcagcagatgcggtgcaaaaagaaattgaagctttaaaagtagaagcagaaaaagctaaagctgatgctgtacaagccaaagctgctgcggataaagcacaggctgaagccgataaagctaaagaaaaagctgaaaatgcaggtggttctgatgctttaaaagatgctctagccgaagctgaagctgctgataaagctaggcaagcagctgaagcagctaaagctgctgcagaattagcagcatctaaagctgaagcagcaaaaaaagcggcagagaatgctctagctgcagaaaaatctgctgcagaaaaagcggtaggtgaagcgaaagctgaagcagataagcgtgtagaggcagcagaaaaacaactggctgatgccaaagcagcagcagccaaagctaaagcagacgctgataaagctaaagcagacgctgacattgcggttcaagatgctaaagaccgtgcagacaaagcagaagcagaagccgttaaagctaaagctgacgccgatgccgccaacaatctagcagcatcagagaaagccaaagcggaagctgctcagaaagaagcagagacggctaaatcagagttagcgcaagctcaaaaagatctagaagcagcagaacaagccttagctgatgccctagcaaatggtggtggtaacaccgaagcgctccaagcagaagtagatcgtagacaggcagcacttgatgcagccaacgacaaagccgcagcagccgagcaagcttcatcagaagcaatcgcagccgctgaggctcaaatagcagcggctaaccaagcagcaaaagatgcccaagatgcattagcagcggcacaaattaagaatgcccctgaatcagcgaagagtggtgtacagaccttgaacgtagacgttgtaccacttggtaaagtctttaaaacaaccacacgcgactttgaagcagatagcactagcgttgttgcccgagctgatctggcctcagaatcagcaccaggcgcaggtgatggcttattaggtcaagtaccagtgacaatttcaggcgataatgatgcagatattgctggtaccaatggctttaaagcgcatgaagacaatgccattgtaggagctttaggacaagagctgccattaacctacacctcaacgtataaggacttcggcgatgacatgcgcattggccacattgatggtaaagcggtgtttagtggtcttgaattgccagtaaatggtgcagcggttattggtaacgcgaccaaagctgagaacatgccaaccgaaggtacagtaggttataccggtgatgccacccatcgtaagttaggtcttggtaacgccattgaatttggttcatctgtatttaccgcagactttgtgaaaaaagcactagatggcaaactaagctttgccaaagcgggtgatattaatcttaaagcgaacatcagcggcaataagttttcaggtggcgcagcagacaacgcaggctacgcaactgaaggtggtttctacggtggtgacgcccagtacctaggtggtgtatatgaaggtaatggtgctcaaggtacttatggtgcgaaatctgacaagcaaactgcagcagaacaagcagccgtagacgcacaagcagcagcagatgcggctcaagcagcaatagcaacagaacaagcaaaagcgcaagcagcacaggcagcagcagagaaagcgaaagcggatgcagcgaaagcacaagcagcattagagaaagctcaagacgccttagcaaatgcgggtagtggtgaagatctactagcggcagcattagaacgtgcagatgcagcagagaaagcacaagaggctgcagaagctgcagaagcggcagctaagacagcagccgagactgctaaagctgcagaaaacgcggctaaagaagctctagtagcggctcaagcagcagcagacaaagctattggtgacgcgaaagctgaagctcaaaagcaagtagacgcagccaaagcggcagaagcggctgcgaagcaagaagcggttaccgcacaagcagcagcagacaaagctaaagcagacgctgaaaaagcgaagacagatgcaggtgttttagttgcagaagcgaacaaacagaaagaacaagcagaagcagaagccgttaaagctaaagctgacgccgatgccgccaacaatctagcagcatcagagaaagccaaagcggaagctgctcagaaagaagcagagacggctaaatcagagttagcgcaagctcaaaaagatctagaagcagcggaacaagccttagctgatgctctagcaagtggcggtggtaacaccgaagcgctccaagcagaagtggatcgtagacaagcggctctagaagcagccaatggcaaagccgcagcagccgagcaagcttcatcaaaagcaatcgcagccgccgaggctcaaatagcagcggctaaccaagcagcaaaagatgcccaagatgcattagcagcggcacaaattaagaatgcccctgaatcagcgaagagtggtgtacagacattaaatgttgacgttgtgccactaggaaaagtctttaagacaaccacacgcgactttgacgcagatggcactagcgtgattgcacgtgctgatttagcctcgcaagatccgactacacctgacacaccaggcttattaggtcaggttccagtgaccatttcaggtgataacgatcaagatgtagcgggtacaaatggctttaagtctcatgaagacagcgccgttgttggtgcgttaggtcaagagctgccattgacgtatacctcaacgtataaagactttggcgatgagatgcgcattggccacattgatggtaaagcggtgtttagtggtcttgaattgccagtaaatggtgcagcggttattggtaacgcgaccaaagctgagaacatgccaaccgaaggtacagtaggttataccggtgatgccacccatcgtaagttaggtcttggtaacgccattgaatttggttcatctgtatttaccgcagactttgtgaaaaaagcactagatggcaaactaagctttgccaaagcgggtgatattaatcttaaagcgaacatcagcggcaataagttttcaggtggcgcagcagataacgcaggctacgcaactgaaggtggtttctacggtggtgacgcccagtacctaggtggtgtatatgaaggtaatggtgctcaaggtacttatggtgcgaaatctgacaagcaaactgcagcagaacaagcagccgtagacgcacaagcagcagcagatgcggctcaagcagcaatagcaacagaacaagcaaaagcgcaagcagcacaggcagcagcagagaaagcgaaagcggatgcagcgaaagcacaagcagcattagagaaagctcaagacgccttagcaaatgcgggtagtggtggtgacggtggtttagctgacgccctagcacgcgtagaagcagccgaagcggcacaagcagcagccgaagacttagcagctaaagcccaagcagcacaaaaagcagctgaagaagcgaaagctgctgcagaaagtgcacaagcagcggctcaagccgcagccgataaagcagtgggtgaggctaaagcaaaagctgaacagttagttgctgaagctaaagcagaagcagaagctgctaacgaagcagctaagattgcgaaagcagatgctgatgcagccaatgttgccgctgaaaaagcgaagacagatgcaggtgttttagttgcagaagcgaacaaacagaaagaacaagcagaagcagaagccgttaaagctaaagctgacgccgatgccgccaacaatctagcagcatcagagaaagccaaagcggaagctgctcagaaagaagcagagacggctaaatcagagttagcgcaagctcaaaaagatctagaagcagcggaacaagccttagctgatgctctagcaagtggcggtggtaacaccgaagcgctccaagcagaagtggatcgtagacaagcggctctagaagcagccaatggcaaagccgcagcagccgagcaagcttcatcaaaagcaatcgcagccgccgaggctcaaatagcagcggctaaccaagcagcaaaagatgcccaagatgcattagcagcggcacaaattaagaatgcccctgaatcagcgaagagtggtgtacagacattaaatgttgacgttgtgccactaggaaaagtctttaaaacaaccacacgcgactttgacgcagatagcagcagcgttgttgcccgagctgatctggcttcacaagacccagctactcctgataaacctggactattaggtcaagtaccagtgaccatttcaggtgataatgatgcagatattgctggaaccaatggctttaaagcgcacgaagacagtgctattgttgaagctttaggtcaagagctgccattgacgtatacctcaacgtataaggacttcggcgatgacatgcgcattggccacattgatggtaaagcggtgtttagtggtcttgaattgccagtaaatggtgcagcggttattggtaacgcgaccaaagctgagaacatgccaaccgaaggtacagtaggttataccggtgatgccacccatcgtaagttaggtcttggtaacgccattgaatttggttcatctgtatttaccgcagactttgtgaaaaaagcactagatggcaaactaagctttgccaaagcgggtgatattaatcttaaagcgaacatcagcggcaataagttttcaggtggcgcagcagacaacgcaggctacgcaactgaaggtggtttctacggtggtgacgcccagtacctaggtggtgtatatgaaggtaatggtgctcaaggtacttatggtgcgaaatctgacaagcaaactgcagcagaacaagcagccgtagacgcacaagcagcagcagatgcggctcaagcagcaatagcaacagaacaagcaaaagcgcaagcagcacaggcagcagcagagaaagcgaaagcggatgcagcgaaagcacaagcagcattagagaaagctcaagacgccttagcaaatgcgggtagtggtgaagatctactagcggcagcattagaacgtgcagatgcagcagagaaagcacaagaggctgcagaagctgcagaagcggcagctaagacagcagccgagactgctaaagctgcagaaaacgcggctaaagaagctctagtagcggctcaagcagcagcagacaaagctattggtgacgcgaaagctgaagctcaaaagcaagtagacgcagccaaagcggcagaagcggctgcgaagcaagaagcggttaccgcacaagcagcagcagacaaagctaaagcagacgctgataaagctaaagcagatgctgacattgcggttcaagatgctaaagaccgtgcagacaaagcagaagcagaagccgttaaagcacagcaagatgctgtaaaagcaaaacaagatgcagagactgcccaacaacaggctaatgatgccaaaaccgcagcagcagaagctgagcaaaaattaaaagctgctcaagataaaattaagcagcttcaagacgagctggaaaatagcggcccaggcggaaacgttaatgttgaggagcttaaagagcaactaaaagccgctcaagaagataaggtaatactagaaagcgagttacaaactgctaaagatgctgaagacaatgctaaagcagccgctgaggctcaaatagcagcggctaaccaagcagcaaaagatgcccaagatgcattagcagcggcacaaattaagaatgcccctgaatcagcgaagagtggtgtacagacattaaatgttgacgttgtgccactaggaaaagtctttaaaacaaccacacgcgactttgacgcagatagcagcagcgttgttgcccgagctgatctggcttcacaagacccagctactcctgataaacctggactattaggtcaagtaccagtgaccatttcaggtgataatgatgcagatattgctggaaccaatggctttaaagcgcacgaagacagtgctattgttgaagctttaggtcaagagctgccattgacgtatacctcaacgtataaagactttggcgatgagatgcgcattggccacattgatggtaaagcggtgtttactggtcttgaattgccagtaaatggtgcagcggttattggtaacgcgaccaaagctgagaacatgccaaccgaaggtacagtaggttataccggtgatgccacccatcgtaagttaggtcttggtaacgccattgaatttggttcatctctatttaccgcagactttgtgaaaaaagcactagatggcaaactaagctttgccaaagcgggtgatattaatcttaaagcgaacatcagcggcaataagttttcaggtggcgcagcagacaacgcaggctacgcaactgagggtggtttctacggtggtgacgcccagtacctaggtggtgtgtatgaaggtaatggtgctcaaggtacttatggtgcgaaatctgacaagcaaactgcagcagagaaagccgcagcagatgcccaggcagcagcagcagcagctcaagctgaagctgataaagccaatactgcagcacaagcagcacaaaaagcagctcaagatgcacaagctcaattggctgataagcaagctgagattgagcgtctgcaaagaagaatcgagaatgcaggatcaggtaatggtgatgcattgcagcagctgcaagatgagttagatgcagcaatcgaagcggctaatcaagctaaacagcaaaaagatgatgcacttgagcaattaactgctgcgcagactaatattactgaacttcaagctacagttgatggcttaaaaggcgataatactcaacttcaagaagatttagcgcaggctaagaaaaatctacaggcacaaatagacagcttaaaggctgataatgaagatcttcaggcccaagctgatgcattacaagaagagcttgataaactaaaaccagatgcacctgaaaatatagagtatgcagtagataacaaaatcacgggtgttcagagtaataagatttctggatataaaggaaaagatggtgctctgaaagctgacagtcaaggtagctatgaaaccttaacgataaaagcacaagatcttgatacagactatgtccgaggtgagtttaaagttattctgaaggataacgagaaagataaggcttatatcagtgctgacggcaaaaaagtcgaaggatttaaagtctatagtaatggagaggccaaagttccaggtactacaactggtgatgcaattaatactagtagaacacttacatatacttccgtatacaacaagtttgctgacatgcagataggtcatgtatatggaaatataccaagtacagcgcctgctcaagatggtaagttatcaacggtttatgcgcaaggtaatgcaactgctgctgaagacatgaagtacatgcaagagcttgctaagcataatttacagcaaggcctgcagaatggtgagggcgtagatagcggtaaagttgggtacgcaggggtttccacctatcagaagaatgatgattactcagggttagtagtgggtacatcagagtttgatgtagactttgtgaatcagcaagtagacggtactctagcattcaaaggtacggatattgataataagaaaatcaaagctgaaatcaacggtaataagttctcaggtaactggaatggcctagatacccaaggtggattctttggccaagatgcggctgagttaggtggtatctataaggatgctggtggtaagggtacttatggtgctggaaaaggcaaagaactaccaggatctactgaagctgatattaccggcttccaatcgactgccttgagtagtgtggctaaaaatgttgagattgcaaatgtcgtattagatgatgcgattggatatgtggagattcgtaacgataaatctaactggtcaggaaaccaagctgatttggttaataaagacgattcattaatacctgtagataccaaagatggtaataactttactggctttgataagttatcagtacgtgctgatatggtaaaacctgagtcagtccaaaagccattggaggtgtcattaggtaaatctggtagtactggtagtgtcacagtagaggcaggtaaaggatcactaaaccctaactttaactataagtcggtatacaaggattttgatgcccagatgcaggtcggccatgtttatggcgtgattaattctggtttcgtaggtgacttatctcgtgtagctaacgtatatgctcaaggttatgcaacgaccgaagaggcaatggccgaccttgccaaggttaatgagggtaaagccaattatacaggtaacgccacctacattgagaacatccacttaggaaatggtgcaggttttgaaccagtaaacggtacttcaaacttcaatgttgactttgtcaataaatctgtgaaaggtgagcttgcctttgacggtgacttcaaatatatgccagaaggtaataagattggtattgaagcggccatcaacggcaatacttttgcaggaaacgtaaacggtatcgatactgctggtggcttctacggtgatgatgcacagttcctagggggtatttaccaagatgcttctgtaacaggtggtaaaggcgacttacctggtacaggaactcgtttccaaggtacctttggtgctgaaaagcaaccagtaaaataa

SEQ ID NO: 1014 - protein, 3225 aa, Psychrobacter sp. PRwf-1
MAKEKVAQEAIAAAEAKQKAAQDIIDAAQNAKDNAQINNAPESAKSGVQTLNVDVVPLGKVFKTTTRDFEADSTSVVARADLASESAPGAGDGLLGQVPVTISGDNDADIAGTNGFKAHEDTAEVDALGNKLPLTYTSTYKDFGDDMRIGHIDGKAVFSGLELPVNGAAVIGNATKAENMPTEGTVGYTGDATHRKLGLGNAIEFGSSVFTADFVKKALDGKLSFAKAGDINLKANISGNKFSGGAADNAGYATEGGFYGGDAQYLGGVYEGNGAQGTYGAKSDKQTAAEQAAVDAQAAADAVQKEIEALKVEAEKAKADAVQAKAAADKAQAEADKAKEKAENAGGSDALKDALAEAEAADKARQAAEAAKAAAELAASKAEAAKKAAENALAAEKSAAEKAVGEAKAEADKRVEAAEKQLADAKAAAAKAKADADKAKADADIAVQDAKDRADKAEAEAVKAKADADAANNLAASEKAKAEAAQKEAETAKSELAQAQKDLEAAEQALADALANGGGNTEALQAEVDRRQAALDAANDKAAAAEQASSEAIAAAEAQIAAANQAAKDAQDALAAAQIKNAPESAKSGVQTLNVDVVPLGKVFKTTTRDFEADSTSVVARADLASESAPGAGDGLLGQVPVTISGDNDADIAGTNGFKAHEDNAIVGALGQELPLTYTSTYKDFGDDMRIGHIDGKAVFSGLELPVNGAAVIGNATKAENMPTEGTVGYTGDATHRKLGLGNAIEFGSSVFTADFVKKALDGKLSFAKAGDINLKANISGNKFSGGAADNAGYATEGGFYGGDAQYLGGVYEGNGAQGTYGAKSDKQTAAEQAAVDAQAAADAAQAAIATEQAKAQAAQAAAEKAKADAAKAQAALEKAQDALANAGSGEDLLAAALERADAAEKAQEAAEAAEAAAKTAAETAKAAENAAKEALVAAQAAADKAIGDAKAEAQKQVDAAKAAEAAAKQEAVTAQAAADKAKADAEKAKTDAGVLVAEANKQKEQAEAEAVKAKADADAANNLAASEKAKAEAAQKEAETAKSELAQAQKDLEAAEQALADALASGGGNTEALQAEVDRRQAALEAANGKAAAAEQASSKAIAAAEAQIAAANQAAKDAQDALAAAQIKNAPESAKSGVQTLNVDVVPLGKVFKTTTRDFDADGTSVIARADLASQDPTTPDTPGLLGQVPVTISGDNDQDVAGTNGFKSHEDSAVVGALGQELPLTYTSTYKDFGDEMRIGHIDGKAVFSGLELPVNGAAVIGNATKAENMPTEGTVGYTGDATHRKLGLGNAIEFGSSVFTADFVKKALDGKLSFAKAGDINLKANISGNKFSGGAADNAGYATEGGFYGGDAQYLGGVYEGNGAQGTYGAKSDKQTAAEQAAVDAQAAADAAQAAIATEQAKAQAAQAAAEKAKADAAKAQAALEKAQDALANAGSGGDGGLADALARVEAAEAAQAAAEDLAAKAQAAQKAAEEAKAAAESAQAAAQAAADKAVGEAKAKAEQLVAEAKAEAEAANEAAKIAKADADAANVAAEKAKTDAGVLVAEANKQKEQAEAEAVKAKADADAANNLAASEKAKAEAAQKEAETAKSELAQAQKDLEAAEQALADALASGGGNTEALQAEVDRRQAALEAANGKAAAAEQASSKAIAAAEAQIAAANQAAKDAQDALAAAQIKNAPESAKSGVQTLNVDVVPLGKVFKTTTRDFDADSSSVVARADLASQDPATPDKPGLLGQVPVTISGDNDADIAGTNGFKAHEDSAIVEALGQELPLTYTSTYKDFGDDMRIGHIDGKAVFSGLELPVNGAAVIGNATKAENMPTEGTVGYTGDATHRKLGLGNAIEFGSSVFTADFVKKALDGKLSFAKAGDINLKANISGNKFSGGAADNAGYATEGGFYGGDAQYLGGVYEGNGAQGTYGAKSDKQTAAEQAAVDAQAAADAAQAAIATEQAKAQAAQAAAEKAKADAAKAQAALEKAQDALANAGSGEDLLAAALERADAAEKAQEAAEAAEAAAKTAAETAKAAENAAKEALVAAQAAADKAIGDAKAEAQKQVDAAKAAEAAAKQEAVTAQAAADKAKADADKAKADADIAVQDAKDRADKAEAEAVKAQQDAVKAKQDAETAQQQANDAKTAAAEAEQKLKAAQDKIKQLQDELENSGPGGNVNVEELKEQLKAAQEDKVILESELQTAKDAEDNAKAAAEAQIAAANQAAKDAQDALAAAQIKNAPESAKSGVQTLNVDVVPLGKVFKTTTRDFDADSSSVVARADLASQDPATPDKPGLLGQVPVTISGDNDADIAGTNGFKAHEDSAIVEALGQELPLTYTSTYKDFGDEMRIGHIDGKAVFTGLELPVNGAAVIGNATKAENMPTEGTVGYTGDATHRKLGLGNAIEFGSSLFTADFVKKALDGKLSFAKAGDINLKANISGNKFSGGAADNAGYATEGGFYGGDAQYLGGVYEGNGAQGTYGAKSDKQTAAEKAAADAQAAAAAAQAEADKANTAAQAAQKAAQDAQAQLADKQAEIERLQRRIENAGSGNGDALQQLQDELDAAIEAANQAKQQKDDALEQLTAAQTNITELQATVDGLKGDNTQLQEDLAQAKKNLQAQIDSLKADNEDLQAQADALQEELDKLKPDAPENIEYAVDNKITGVQSNKISGYKGKDGALKADSQGSYETLTIKAQDLDTDYVRGEFKVILKDNEKDKAYISADGKKVEGFKVYSNGEAKVPGTTTGDAINTSRTLTYTSVYNKFADMQIGHVYGNIPSTAPAQDGKLSTVYAQGNATAAEDMKYMQELAKHNLQQGLQNGEGVDSGKVGYAGVSTYQKNDDYSGLVVGTSEFDVDFVNQQVDGTLAFKGTDIDNKKIKAEINGNKFSGNWNGLDTQGGFFGQDAAELGGIYKDAGGKGTYGAGKGKELPGSTEADITGFQSTALSSVAKNVEIANVVLDDAIGYVEIRNDKSNWSGNQADLVNKDDSLIPVDTKDGNNFTGFDKLSVRADMVKPESVQKPLEVSLGKSGSTGSVTVEAGKGSLNPNFNYKSVYKDFDAQMQVGHVYGVINSGFVGDLSRVANVYAQGYATTEEAMADLAKVNEGKANYTGNATYIENIHLGNGAGFEPVNGTSNFNVDFVNKSVKGELAFDGDFKYMPEGNKIGIEAAINGNTFAGNVNGIDTAGGFYGDDAQFLGGIYQDASVTGGKGDLPGTGTRFQGTFGAEKQPVK

SEQ ID NO: 1015 - DNA, 2259 bp, Psychrobacter sp. PRwf-1
atgtccctagtgaatttatcgaaacttagttttgtagttgtattgggattaggtgttgttgcatgcagtagtggtggttcaagctcatcatttgggggtagctctccaatcataactccggaacaacaggcgcaaaaaatcgaagctaatcgtgtggctttagtagcaaaagctaaaaaagcaggtctaacagaggttcaagcgaatgcttatgcagaagctaacaaagaggccagtgtcaacgatgctgaaagtgctttaaataaaattctagcggatattgaggcagagcgtttagagaaaatcgaagcgaatcgtgtagccttagtagcaaaagctaaaaaagcaggtctaacagaggctcaagcgaatgcttatgctcaagctaacaaagaagtcagtaccaaagatgctgaaagtgctttgaataaaattctagcggatattgaggcagagcgtttagagaaaatcgaagcgaatcgtgtagcattagtagctaaagcgaaaaaagcaggtctaacagaggctcaagcaaatgcttatgctcaaactaacaaagaagtcagtaccaaagatgctgaaagtgctttgaataaaattctagcggatattgaggcagagcgtttagagaaaatcgaagcgaatcgtgtagcattagtagctaaagcgaaaaaagcaggtctaacagaggctcaagcgaacgcttatgctcaagctaacaaagaagtcagtaccaaagatgccgaaagcgctctaagcaaaattttagctgatattgcagaagcacagcgtttagagaagattgaagcgaatcgtgtagcgttagtagcaaaagcgaaaaaagcaggcttaacagaggctcaagcgaacgcttatgctcaagctaacaaagaaggcaataccaaagatgctgaaagcgctctaaacaaaattttagctgatattgcagaagcacagcgtttagagaagattgaagcaaatcgtgtagcgttagtagcaaaagcgaaaaaagcaggtttaacagaggctcaagcaaatgcttatgctcaagctaacaaagaagccaataccaaagatgctgaaagtgctttaaataaaatcctagctgatattacagaagcacagcgtttagagaagattgaagcaaatcgtgtagcgttagtagcaaaagcgaaaaaagcaggtttaacagaggctcaagcaaatgcttatgctcaagctaacaaagaagccaataccaaagatgctgaaagtgctttaaataaaattttagccgatattgaggcagagcgtttagagaagatcgaagcgaatcgtgtagcgttaatagcaaaagcgaaaaaagcaggcttaacagatgctcaagcgaacgcctatgctcaagctaataaagaagcgagtactaaagatgctgatagtgctttaaacaaaattttggctgatattgcagaaacaaagcgtctagagaaaatcgaagctaaccgtgtagcgttagtagcaaaagctaaaaaagcaggtttaacggatgctcaagcagagtcctatgcagaagctaacaaagaagccagtgccaaagatgctgatactgctttaaacaatattttggctgagattaaagagcatgaaagacttgctttagaagctgcagtttctttagaaaaaggccattatgataatccagcacgctatcctgaatatttagttacggcacatcagttatcttatagtgatagcacactgaataatgatagaacaatcaatattgagcatgaagtagtttacaatcagccttattctgttgttattgggagctactctagctggacgaaaggaataggttcgtatatttttagctcaggcatggattcaagctttacaactaagggcttaaaaacaaaagcagatgctattccgagcttaggaaaggcgaattactctggacttgcatttagtagtgaagaaaatcctatttttgcttcaacttcgggttactataaagaagggctattatcatatgatgtagactttggaagtcgcaaaggctctggaacaattaccgggttaggggatgtggttgagctacatgaagggactatctccggttctggtatatcttcattggccactcagtcatataaaactggagattattcgttagggttctatggtaaaaaagctgaagaaatcgttggtaccattgcgtttgaaggtaaagatactattggttttggtggtacgcgtggcgaaatcactaaatag

SEQ ID NO: 1016 - protein, 752 aa, Psychrobacter sp. PRwf-1
MSLVNLSKLSFVVVLGLGVVACSSGGSSSSFGGSSPIITPEQQAQKIEANRVALVAKAKKAGLTEVQANAYAEANKEASVNDAESALNKILADIEAERLEKIEANRVALVAKAKKAGLTEAQANAYAQANKEVSTKDAESALNKILADIEAERLEKIEANRVALVAKAKKAGLTEAQANAYAQTNKEVSTKDAESALNKILADIEAERLEKIEANRVALVAKAKKAGLTEAQANAYAQANKEVSTKDAESALSKILADIAEAQRLEKIEANRVALVAKAKKAGLTEAQANAYAQANKEGNTKDAESALNKILADIAEAQRLEKIEANRVALVAKAKKAGLTEAQANAYAQANKEANTKDAESALNKILADITEAQRLEKIEANRVALVAKAKKAGLTEAQANAYAQANKEANTKDAESALNKILADIEAERLEKIEANRVALIAKAKKAGLTDAQANAYAQANKEASTKDADSALNKILADIAETKRLEKIEANRVALVAKAKKAGLTDAQAESYAEANKEASAKDADTALNNILAEIKEHERLALEAAVSLEKGHYDNPARYPEYLVTAHQLSYSDSTLNNDRTINIEHEVVYNQPYSVVIGSYSSWTKGIGSYIFSSGMDSSFTTKGLKTKADAIPSLGKANYSGLAFSSEENPIFASTSGYYKEGLLSYDVDFGSRKGSGTITGLGDVVELHEGTISGSGISSLATQSYKTGDYSLGFYGKKAEEIVGTIAFEGKDTIGFGGTRGEITK

SEQ ID NO: 1017 - DNA, 693 bp, Rhodobacteraceae bacterium PD-2
atgcgcattgcaaatcttgggcggctcggcctggtgctggtgcttggcacatcgctgtccggctgtttgggtagcagcagcggtggcggcggcggcggagccggtgggggcggcggtggcggcggcggcggcggctcaagcttcgacaccgagttcgaccgcgttaccgccaaggctccgacgtcgaacatgccgaccgagatcaacgcctcctatgccggacggctgaaggtggacgtgaccgacccgaccacgaccatcggcgaggtcgagggcaacctgaacctcgatgtggcctggcgcgatggacagaccacgaacccgttcaccgggaccgcgtcggatttcaccggcacgctggtgaccggcgagaccggcgccattgacggcacgctgaccgtggacgacagcttcggcgggtccatcagccgggtggtcaatcccgcgatggaggtggccggcgtctcggtccccgagacacagatcggggcgctgaccgtcaccctcaccggcgaactgagtcagggcggcaccacggccgacacgaatatcatgctcggcgggtcgttcttcggcgatgccggtgaagccgcgcttgggccggtggtcggtggttacaacctgccggactcggccaatccggcgatattcgacggcgccatcgcaggcacctactacatcgaacaggaatga

SEQ ID NO: 1018 - protein, 230 aa, Rhodobacteraceae bacterium PD-2
MRIANLGRLGLVLVLGTSLSGCLGSSSGGGGGGAGGGGGGGGGGGSSFDTEFDRVTAKAPTSNMPTEINASYAGRLKVDVTDPTTTIGEVEGNLNLDVAWRDGQTTNPFTGTASDFTGTLVTGETGAIDGTLTVDDSFGGSISRVVNPAMEVAGVSVPETQIGALTVTLTGELSQGGTTADTNIMLGGSFFGDAGEAALGPVVGGYNLPDSANPAIFDGAIAGTYYIEQE

SEQ ID NO: 1019 - DNA, 1131 bp, S. bongori
atggccacgaatgaaacctcccaggtcgaaagtataagcgcatcagcgcccccaaattcatctggtaataatactgttgagttaaatgaaactgtcggtacagcaggaactcactccgccagtaacacggggatacctgtcgctaatgaagccacagctccgtcgtgcggcccatcaattgcgtgcggtggcggaggaaatagcaataaagcacccagtacaaccacgggtgaaacctcccaggtcgaaagtatcggtacatcagggacctccggttcatctgataataattcgggtgaggtaactgaaacagtcgattctgtagaaaataactctactgtcaataccggaacaccggtaattaatgaggctacactacaggataaacctgcaatatcaacaccgacgaacaagactcatatttcagaggctaagtatgacacaggtacgatcctcacccgtacagtaaatgatattgactccgccatgattcataaaagtaatgtagtagacgatcctgatgtctttgctatcaaaatgaaagacggtgaggtcattgtggatgtcaaaccactcaataccggcgatccagaagactatcgtaagcttgtatccaaaaatcttaatattctgcgggataagagtggtgaagctatcgggttttacggccttgtggaaacgtatacgaatcaaaccgatctgaggactctgacaggtaaaaatagatatggcagagttgattatattgttgccatgaacggagaagaaaagaagcttccttctgtcacagctgactatatcggtaaactttactacgatcaggagcaggctccagcaaaagaagctgatattagtcttcactatgaagaacgtcagattagtggaacaataatagataaagatcgcccacatttcagcctggaaattgatacccgaaaacctcacaaagtggatgaggatggcagtttcatggctgcgttagtgggtaggaatgatcgtacagatgaaaaaatgcacggatacattgatggtaatttttatggaaaggatggcgaaattgtcgccggttcggtacgttccaaagctgataacagctggggaggtgtatttgggggagaaaagcaggaataa

SEQ ID NO: 1020 - protein, 376 aa, S. bongori
MATNETSQVESISASAPPNSSGNNTVELNETVGTAGTHSASNTGIPVANEATAPSCGPSIACGGGGNSNKAPSTTTGETSQVESIGTSGTSGSSDNNSGEVTETVDSVENNSTVNTGTPVINEATLQDKPAISTPTNKTHISEAKYDTGTILTRTVNDIDSAMIHKSNVVDDPDVFAIKMKDGEVIVDVKPLNTGDPEDYRKLVSKNLNILRDKSGEAIGFYGLVETYTNQTDLRTLTGKNRYGRVDYIVAMNGEEKKLPSVTADYIGKLYYDQEQAPAKEADISLHYEERQISGTIIDKDRPHFSLEIDTRKPHKVDEDGSFMAALVGRNDRTDEKMHGYIDGNFYGKDGEIVAGSVRSKADNSWGGVFGGEKQE

SEQ ID NO: 1021 - DNA, 1242 bp, S. japonicum; identical to SEQ ID NO: 583

SEQ ID NO: 1022 - protein, 413 aa, S. japonicum; identical to SEQ ID NO: 586

SEQ ID NO: 1023 - DNA, 1371 bp, S. lithotrophicus
atgacccctcaagagcgtttcaaattgacccggcaggcgatgttgctggccacgatctcggcggcttttccggtgacggcatattgtgctgccggtcgtgtggatttcacgatcggcaatgtggaggcgatcgcagcaaatggcagccggcatccggtctacaaaggcaccgagatcaattccggcgagacgatcaacactgcggcgggtgcgcgagcacaggtgcgttttgccgacggcggtttcgtttcgctgcaacccggtaccgtattccgggtggatgaattcaactacaagggcaaggcggatggcgaggaaaagggtttcttcagcctgctgaaaggcgggttcagggcgatcaccggcgtgatcggccatctcaacaaggacacttaccgggtcaagacaccggcggccaccctcggcatccgcggtaccggatacaacatggcgctgcgtgatgacggcctgttcgtgaacgtcggagaaggagcgatttcgctgaacaataacggcgggctgctggtggtcacggccggcaatgcggcctatgtggcgaacttcaatactgcaccggtgcccactaccgagcagccgcttacgccgccgaacgggttgcaggagccgactttcacggtggctgaccagcgcgacaactcggggagcctggctttgatcagtctgccgtcggggcctggctatgcgatggccgatgcgtatacgacaacggctgctgccttcggtaccaatctgctgaccggcgtcaccgcccttttcagtggcgccagccagttgacccaatataactggatcgatgttaacggagcgccgcaaaccggatcgcttggcggagccgcggtctccttttccgcgactgacggcatcatcggctgggggcgctgggtcggcactacggcaggaaccgcagcaccgaaccctttgaccggcgtcttcgactacgtgatcggtattcccaccgcagccatgccgacaacaggcacggcaacctacagcctgatgggctataccagtccgacagctacggatggatcgaccgggtatagtgtgaatggaactctcgcggttaatttcgctgcgacctcaggacaggtcggcgtgaacatgacagtggcgaacagttcaaccaatacatacgggatcaatggcgcactgacaataacaccgggcactgcgacttttgccggggtcaccaattacaccaacctgaccaattgcacagcaggatgttccacgtcagtcaacgggttctttgccggagccagcgcgtcgcgagccgggctgtcctactcgatcaccaataacctcacagctaatcacattcagggtgtggcggctttcgcgaagaattaa

SEQ ID NO: 1024 - protein, 456 aa, S. lithotrophicus
MTPQERFKLTRQAMLLATISAAFPVTAYCAAGRVDFTIGNVEAIAANGSRHPVYKGTEINSGETINTAAGARAQVRFADGGFVSLQPGTVFRVDEFNYKGKADGEEKGFFSLLKGGFRAITGVIGHLNKDTYRVKTPAATLGIRGTGYNMALRDDGLFVNVGEGAISLNNNGGLLVVTAGNAAYVANFNTAPVPTTEQPLTPPNGLQEPTFTVADQRDNSGSLALISLPSGPGYAMADAYTTTAAAFGTNLLTGVTALFSGASQLTQYNWIDVNGAPQTGSLGGAAVSFSATDGIIGWGRWVGTTAGTAAPNPLTGVFDYVIGIPTAAMPTTGTATYSLMGYTSPTATDGSTGYSVNGTLAVNFAATSGQVGVNMTVANSSTNTYGINGALTITPGTATFAGVTNYTNLTNCTAGCSTSVNGFFAGASASRAGLSYSITNNLTANHIQGVAAFAKN

SEQ ID NO: 1025 - DNA, 921 bp, S. muelleri
atggtaaatttaaagctttcagtaatcgctaccgcaatggtttttgcattaacggcatgtggtagtagtggcgatagcagtggtgctggttttggaagagtgaattttaattcaaatagccaatctgctgccaatagtgcaaccaataatggtacaactaaaacgtcaggttttacattgaataaaggcaaaaccaccaatacggcaaatacaagtaccaatacagtaggtaaaacaaccacgcctaccccagctaatacagcaaccacaaagccagcagtacaagcaaatacaaataatggtttggcattaatcggttacgatagaaatggtgtaaatgtgagtccagttgccatcagcagtgcagatttaaacaaagtaacgattgatggtactgaggttactttgtcgcaaccaggtatttcagcaggtacatttaccactatcagcaacaatacaaaagagactattgccagtggtcgtgccttgagttatagccgtattggtgcgtatcgtgattttaatgatgcacaaggcagaaacccatcttttacttttgtagtaggtagcgttacaccaactgcacaagtgccaacttctggtcaagcaacgtatgatggtttatctttagtgagcattgtaggaggtggagcattttcaaaagggacatctaatttcaatgtggattttggtagcaaaaaaattatgggtacagtgaaagcgaattcggatgtgactattgtgccattagaaggtaaaattgatggcgcatctttcagtggtaccaaagatggtgttaatatgagtggtcagttctatggtccgcaagcggctgagttgggtggtgtattcaatggtacacaacaaaatggtagtacatttaatgagttaatgggtgtgtttggtgccacaaaacaataa

SEQ ID NO: 1026 - protein, 306 aa, S. muelleri
MVNLKLSVIATAMVFALTACGSSGDSSGAGFGRVNFNSNSQSAANSATNNGTTKTSGFTLNKGKTTNTANTSTNTVGKTTTPTPANTATTKPAVQANTNNGLALIGYDRNGVNVSPVAISSADLNKVTIDGTEVTLSQPGISAGTFTTISNNTKETIASGRALSYSRIGAYRDFNDAQGRNPSFTFVVGSVTPTAQVPTSGQATYDGLSLVSIVGGGAFSKGTSNFNVDFGSKKIMGTVKANSDVTIVPLEGKIDGASFSGTKDGVNMSGQFYGPQAAELGGVFNGTQQNGSTFNELMGVFGATKQ

SEQ ID NO: 1027 - DNA, 543 bp, S. pontiacus; identical to SEQ ID NO: 977

SEQ ID NO: 1028 - protein, 334 aa, S. pontiacus
MKLYMQLMTTTALALSVAACGSSNGVDKVIDVTDITEEAQAKRTFATDEDGDPVDAGAAIASGKTLTARAVGVALQNLNYHTGETSTTTDVTASIKRNDDGALTVTIDGEELAFTPADVNGEGDGYEVEVDGKFAGVYNFNGPVEELLTAGNGFAQVVSIFRTSENAEGHVSGDNTFAIFGTETADEDLKDLPKAEYTGRSRINVVPNSGFESNSESRYKVRSEIAMTADFGAGEIWGTIGNTTIEDPEDGERDAVEGTIAMDKTTFDNNGFAGTLTADADFISDIDVNSAEGTYSGAFYGPNAEQVAGALTFGIGADDGSLNGNGYFSADKVD

SEQ ID NO: 1029 - DNA, 705 bp, S. pontiacus
atgaaacacgcacgtcttagtattgttattgcaagccttggggcggcaacggtcttgtctggttgcaatggaagcagctccgccggcgggcttgttggcggcggcgcaggcggcgggcaggattttgaaacagcctttaacgctgtcagtcaaaaggcccccacttcggatatgcccacgtcgctgaaagccagctacgaaggtcagatgaaggtcggcgtgaacagcggatcggcccagattttcggcaccgatatggatgcgaatagcgcggaaatcattggcgatctggcagtcgatgtggattggaccgacgggcagaccaccaatccgttcaccggaaccgcctccaacatcgtcgcgacagaggcgggcacctcgaactccgtcaaactggacgggacgctgacggtcgatcaaggtttgccagcctcactcagccgcaccaccattccggcgcaggtcgtcgcgggcgtcaatatccccgagcagaacaccggcgcgatgctgttccatatgtccggtcggcttagcagtggcgagaacgaaggggacgccaccttgcagttcggcggcaacttcatgggaccgggtgcagaatcgatgcttggaccggtatctggcggtatcaacgatgtgaacaatccctcgccgcagattttcgatgcgggcgtcggtggtacattctacgccaacaagaaatag

SEQ ID NO: 1030 - protein, 234 aa, S. pontiacus
MKHARLSIVIASLGAATVLSGCNGSSSAGGLVGGGAGGGQDFETAFNAVSQKAPTSDMPTSLKASYEGQMKVGVNSGSAQIFGTDMDANSAEIIGDLAVDVDWTDGQTTNPFTGTASNIVATEAGTSNSVKLDGTLTVDQGLPASLSRTTIPAQVVAGVNIPEQNTGAMLFHMSGRLSSGENEGDATLQFGGNFMGPGAESMLGPVSGGINDVNNPSPQIFDAGVGGTFYANKK

SEQ ID NO: 1031 - DNA, 696 bp, S. stellata
atgcgcattgcaaatcttgggcggcttagcctcgccctggtgcttggcacatcgctgtccggctgcctgcagggcagcagtggtggcggagctggcggtggtggaactggcggtggcggcggaggaggcggtggcagctcaagcttcgacaccgagttcgatcgcgtcacggccaaggcgccgacgtcgaacatgccgaccgcgatcaacgcatcctacgccggacggcttaaggttgacgtgaccgatccttccagcaccatcggtgaggtcgagggcgatctggacctcgatgtggcctggaatgatggacaggccaccaacccgttcaccgggaccgcgtcgaatttcaccggcacgctggtgaccggccaaacaggcaccattgacggcactctgaccgtagacaacagcttcggcgggtccatcagccgggtggtcaatccctcgatgaacgtgggcggggtcaccatccccgagacacagatcggggcgctgagcgtcactctcaccggtgagttgagccagggcgggaccgctgccgacacgcagataacgctcggcgggtcgttcttcggcgatgccggtgaggccgcgcttgggccggtggtcggcggttacaacctgccgaactcgggcaatccggcggtgttcgacggtgccatcgcaggcacctattatatcgaacaaaaatga

SEQ ID NO: 1032 - protein, 231 aa, S. stellata
MRIANLGRLSLALVLGTSLSGCLQGSSGGGAGGGGTGGGGGGGGGSSSFDTEFDRVTAKAPTSNMPTAINASYAGRLKVDVTDPSSTIGEVEGDLDLDVAWNDGQATNPFTGTASNFTGTLVTGQTGTIDGTLTVDNSFGGSISRVVNPSMNVGGVTIPETQIGALSVTLTGELSQGGTAADTQITLGGSFFGDAGEAALGPVVGGYNLPNSGNPAVFDGAIAGTYYIEQK

SEQ ID NO: 1033 - DNA, 1863 bp, S. yanoikuyae
atgacgaaacaggctcttcgcggcgcgagcgcgatcgccttcatgctggcgctttctgcatgtggcgggggtggtggcgtgaacagtacgcccactcccacgccagcacctactccgactccgacgcccacacccacacccacaccgagcgccaatgcggatctggtcgcaccgcttgtttcggaaactttcgtcaataatgcggtggctggcacagccagcttcccggcaaatggagcaggtacggcgacagccgccaagtctgcgctgacgttccgttatgatgcgtcgagcaatcgctattcggtgtcggcggccgaccgttcgcagaattttgctgtatcgagcagggatgctgcgctcagcaatgcggacctcgacgtttatgtcgataaatcgggtaaccgcacagacacgttggccgttcgtaagaacgcagccgagaaggggacgcctgacagcccgcaattccaatatgccggcgctgccgtgtggcaacgcaccacagcaaatagcagcgcagtgagcgccacagcggatgcctttacctatggcgtggaaacaaaggcttcggccatgccgctcggcggcaccgcaacttttgtggcatcgctgaacggcattgccacctatgccgacacggcactgggcctcaagggaggcggcactctcaacatcgatttctcctctggcggcctgaccggcaatggtgatttttccacctatggaacggatggcggaaaggtggacaccagcaactggtatgccagcgccaggatcgcgtccggatccaatgccttcagcggtagtttcacgatcggggcgcccagcaacccggccgggtcgttcgatggacgcttttatggccccaaccatgaggagcttggtgcggcctggagctggaacacgccgacaggagggcgcgcctatttgggtacgctgctggggcgcgacctggcaacattgccggccaatggcgggctggatgcgctgcgcgtcaatgaggcgtttgagaccacgggcatgcaggcgcaatatatcctgacctcgcccaccaacagctatatgcagcgcatcaccagcctgacgacaccgcccgtcaccatgcgctattcggaagatagcgatagtctggtggtcaatcagtttgcggtggtcagcgatgtcgccttgaccgacgcgatcagggatgctgcggccagcaatgcgtccttcgacgtctatcggaccacgaagacggaaacatttggtggggtcgccagcgaatatccgatcgagatccgtgtcctgaaaccgggcgccggaaacccgacgattgcgctgacctataccagctttgcaacctggtcggttggtcccgttcccagtctgtatcagtccgacgtcaacgaaactgtgctggcctatggccgcaagacgccggatggcgcgatgccgcggtctggttcggccagctatgcggcgatcatccaggggatcacgactgtgcccgtaagtgccagtgcaacgcagcggccctatgtcatcacgggcgatgcaagcctctcctatgatttcgccgcggcccgaatgtcgggcgtgatgcgccccgtggcaaccgatcgcgatagcgggcagcgctacgaactgggggcgcagaattttgccggaagttccattgtcggctcatccagcttttcgggacagttcgaaaaggaaatgaccattcgtggcattggcaccactaatggcagcatcaacggccagtttaccggcccgcaggcgcaggaattctttgcgcgctggaattatggcatgatcgatccggtcaatggcggcacgctcaacatgggcggcgtcatggtcggcaagcagacgcagtag

SEQ ID NO: 1034 - protein, 620 aa, S. yanoikuyae
MTKQALRGASAIAFMLALSACGGGGGVNSTPTPTPAPTPTPTPTPTPTPSANADLVAPLVSETFVNNAVAGTASFPANGAGTATAAKSALTFRYDASSNRYSVSAADRSQNFAVSSRDAALSNADLDVYVDKSGNRTDTLAVRKNAAEKGTPDSPQFQYAGAAVWQRTTANSSAVSATADAFTYGVETKASAMPLGGTATFVASLNGIATYADTALGLKGGGTLNIDFSSGGLTGNGDFSTYGTDGGKVDTSNWYASARIASGSNAFSGSFTIGAPSNPAGSFDGRFYGPNHEELGAAWSWNTPTGGRAYLGTLLGRDLATLPANGGLDALRVNEAFETTGMQAQYILTSPTNSYMQRITSLTTPPVTMRYSEDSDSLVVNQFAVVSDVALTDAIRDAAASNASFDVYRTTKTETFGGVASEYPIEIRVLKPGAGNPTIALTYTSFATWSVGPVPSLYQSDVNETVLAYGRKTPDGAMPRSGSASYAAIIQGITTVPVSASATQRPYVITGDASLSYDFAAARMSGVMRPVATDRDSGQRYELGAQNFAGSSIVGSSSFSGQFEKEMTIRGIGTTNGSINGQFTGPQAQEFFARWNYGMIDPVNGGTLNMGGVMVGKQTQ

SEQ ID NO: 1035 - DNA, 1284 bp, Salmonella enterica subsp diarizonae
gtgaatacattatcggtttcccgtctggcgctggcactggcttttggcgtgacgctgagcgcctgtagctctacgccacccgatcaaatcccttccgatcaaaccgcgcctggcaccgcctcgcgcccgattctgtcggcaaatgaagcgaaaaacttcgttgcggcgcactatttcgcctctctgacgccgaataccgcgccgtggtcgccgtcaccgattactttgcccgcgcagcctgactttgtggtcggtccggcaggcacgcctggcgttacgcacacctcgattcaggccgccgtcgatgcggcaatggttaaacgcacgaataaacgccagtacatcgctattatgccgggcgcctatcagggtaccgtctacattcccgccgcgccgggaagtctgacgctgtatgggacaggtgaaaaaccgatcgatgtaaaaatcggtatggcgattgatggtgaaatgagcatcgccgactggcgccgcgcggtgaatcccggagggaaatatatgccgggtaaacccgcgtggtatatgttcgataactgccaaagcaaacgtgcagcaacgatcggcgtgatgtgttctgctgcgttctggtcgcaaaataacggactgcagctacaaaacctgaccatcgaaaacacgttgggcgacagcgtcgatgccggaaaccatcctgcggtggcgctgcgtaccgatggcgataaggtccagattaacaaggtcaatatccttggccgtcagaataccttctttgtgaccaatagtggcgtgcagaaccgtctgcaaaccgatcgccagccgcgtacgctggtgacgaacagctatattgaaggcgatgtagatatggtttccggacgcggcgccgtggtgttcgataacactaacttccaggtcgtcaactcccgcacgcaacaggaagcctacgtgttcgcccctgcgacgctatccaatatttactatggcttcctggcgatcaatagccgctttagcgcatccggcgatggcgttgcgcagcttggccgctcgctggatgttgacgccaacaccaacggccaggtggtgatccgcgacagtgtgattaacgagggctttaacatcgccaaaccgtgggccgacgcggtcatctcgaaacgtccgtttgccggaaatacgggaaccgtggatgacaaaggcgaggtgcagcgtaatctgaacgacactaactacaaccgcatgtgggaatacaacaaccgcgggccaggcagtaaagtggtaacggagcctaagcagtaa

SEQ ID NO: 1036 - protein, 427 aa, Salmonella enterica subsp diarizonae
MNTLSVSRLALALAFGVTLSACSSTPPDQIPSDQTAPGTASRPILSANEAKNFVAAHYFASLTPNTAPWSPSPITLPAQPDFVVGPAGTPGVTHTSIQAAVDAAMVKRTNKRQYIAIMPGAYQGTVYIPAAPGSLTLYGTGEKPIDVKIGMAIDGEMSIADWRRAVNPGGKYMPGKPAWYMFDNCQSKRAATIGVMCSAAFWSQNNGLQLQNLTIENTLGDSVDAGNHPAVALRTDGDKVQINKVNILGRQNTFFVTNSGVQNRLQTDRQPRTLVTNSYIEGDVDMVSGRGAVVFDNTNFQVVNSRTQQEAYVFAPATLSNIYYGFLAINSRFSASGDGVAQLGRSLDVDANTNGQVVIRDSVINEGFNIAKPWADAVISKRPFAGNTGTVDDKGEVQRNLNDTNYNRMWEYNNRGPGSKVVTEPKQ

SEQ ID NO: 1037 - DNA, 930 bp, Simonsiella muelleri ATCC 29453
atgtcattagcccctaagtctaaacttaaagttttgaacgctaagggtgaagatgcatcagctggtaatgaactccgtaaacctaaatctgataatacttcgattgttggtcaaatgtacggtgcgaaaatcactaatgttaaagaagatggtgaagaaacaaatgcgccatttacccaaaaaccttataagaatgttcagtatggtagtttgacttctgctttacatgcccaagatatttcaacattagaaaatggggacgaggtggatactaaaattgctaagtatggttacactggcactctaggtactgaagataattacttctaccgtttaaatgagaataacatggatgtagctggattgaaaaaacttaaaaatgataatccaaacacagtgttgaaatacgatggtcatgcggtaacttatggtattgataatagctgggttggtccagctaaagccaaagtcaatagtgtacctacagccattgtggctgctgagaaagcagctgactcaggtttagtgagtggtacacatgttactgctaaaattaacttgaataccaatgctgtagaaggtaacttgtacaataaatggtatgatggtgcgttgaaaggcgttaaagatgttcgtttagtagattttactggttctatgtctgagaatggtaatattgctggtacatcgcataacaacatcgataatactggtggtttatttggtgcatctttaaataaagaggcaacagaaatgggcggtgtggtttcatctaatgaccatacagcaggaaataaatggggtgctgtatttggtgctcagttgacaggtcgcgaaactgttgtacctgctaaaacaggaactcctgctgatccggttaagcctgctgatgaaccaagtattaatagttctggtaatgttactagataa

SEQ ID NO: 1038 - protein, 309 aa, Simonsiella muelleri ATCC 29453
MSLAPKSKLKVLNAKGEDASAGNELRKPKSDNTSIVGQMYGAKITNVKEDGEETNAPFTQKPYKNVQYGSLTSALHAQDISTLENGDEVDTKIAKYGYTGTLGTEDNYFYRLNENNMDVAGLKKLKNDNPNTVLKYDGHAVTYGIDNSWVGPAKAKVNSVPTAIVAAEKAADSGLVSGTHVTAKINLNTNAVEGNLYNKWYDGALKGVKDVRLVDFTGSMSENGNIAGTSHNNIDNTGGLFGASLNKEATEMGGVVSSNDHTAGNKWGAVFGAQLTGRETVVPAKTGTPADPVKPADEPSINSSGNVTR

SEQ ID NO: 1039 - DNA, 1005 bp, Sulfitobacter sp. CB2047
atgaaactttacatgcaattgatgacaacgaccgcgctggcgctgagcgtcgcggcctgcgggtcatcgaacggggtcgacaaggtgattgatgtgacagacatcaccgaagaggcgcaggccaaacggacctttgcaacagacgaggatggtgatccggtcgatgccggtgcagcgattgcgtccggcaagacgctgaccgcgcgcgccgtgggcgtcgccttgcagaacctgaactatcacaccggggaaaccagcacgacgactgatgtcaccgcgtcgatcaagcgcaataatgatggcgcgctgaccgtgaccatcgacggcgaagagctggcgttcacccctgccgacgtgaatggcgaaggtgacggctacgaggtcgaagtggatggcaaattcgccggggtctataactttaatggtccggtcgaagaactgctgacggcgggcaatggctttgcccaggtggtaagcattttccggacatccgagaacgccgaaggtcacgtctccggcgacagtacctttgcgatctttggcacagagacggcggatgaagatctgaaggatctgccaaaagccgaatatacgggccggtcgcggatcaatgttgtgccaaacagcggcttcgaatcgaacagcgaaagccggtacaaggtgcgtagcgagattgcgatgacggcagactttggcgccggcgagatctggggcaccatcgggaacaccaccatcgaagaccccgaagacggtgaacgtgacgccgttgaagggaccatcgcgatggataaaaccacgttcgataacaacggttttgccgggacattgacggcagatgcggacttcatcagcgatatcgacgtcaatagcgccgaagggacgtactccggtgcgttctatgggccaaacgccgaacaggttgccggtgcgctgacatttggtatcggcgctgacgacgggtcgctgaacgggaacggctacttctcggccgacaaagtcgactaa

SEQ ID NO: 1040 - protein, 334 aa, Sulfitobacter sp. CB2047
MKLYMQLMTTTALALSVAACGSSNGVDKVIDVTDITEEAQAKRTFATDEDGDPVDAGAAIASGKTLTARAVGVALQNLNYHTGETSTTTDVTASIKRNNDGALTVTIDGEELAFTPADVNGEGDGYEVEVDGKFAGVYNFNGPVEELLTAGNGFAQVVSIFRTSENAEGHVSGDSTFAIFGTETADEDLKDLPKAEYTGRSRINVVPNSGFESNSESRYKVRSEIAMTADFGAGEIWGTIGNTTIEDPEDGERDAVEGTIAMDKTTFDNNGFAGTLTADADFISDIDVNSAEGTYSGAFYGPNAEQVAGALTFGIGADDGSLNGNGYFSADKVD

SEQ ID NO: 1041 - DNA, 705 bp, Sulfitobacter sp. CB2047
atgaaacacgcacgtcttagtattgttattgcaagccttggggcggcaacggtcttgtctggttgcaatggaagcagctccgccggcgggcttgttggcggcgtcgcaggcggcgggcaggattttgaaacagcctttaacgctgtcagtcaaaaggcccctacttcggatatgcccacgtcgctgaaagccagctacgaaggtcagatgaaggtcggcgtgaacagcggatcggcccagattttcggcaccgatatcgatgcgaatagcgcggaaatcattggcgatctggcagtcgatgtggattggaccgacgggcagaccaccaatccgttcaccggaaccgcctccaacatcgtcgcgacagaggcgggcacctcgaactccgtcaaactggacgggacgctgacggtcgatcaaggcttgccagcctcgctcagccgcaccaccattccggcgcaggtcgtcgcgggcgtcaatatccccgagcagaacaccggcgcgatgctgttccacatgtccggtcggctcagcaatggcgagaatgaaggagacgccaccttgcagttcggcggcaacttcatgggtccgggtgcagaatcgatgcttggaccggtatctggcggtatcaacgatgtgaacaatccctcgccgcagattttcgatgcgggcgtcggtggtacattctacgccaacaagaaatag

SEQ ID NO: 1042 - protein, 234 aa, Sulfitobacter sp. CB2047
MKHARLSIVIASLGAATVLSGCNGSSSAGGLVGGVAGGGQDFETAFNAVSQKAPTSDMPTSLKASYEGQMKVGVNSGSAQIFGTDIDANSAEIIGDLAVDVDWTDGQTTNPFTGTASNIVATEAGTSNSVKLDGTLTVDQGLPASLSRTTIPAQVVAGVNIPEQNTGAMLFHMSGRLSNGENEGDATLQFGGNFMGPGAESMLGPVSGGINDVNNPSPQIFDAGVGGTFYANKK

SEQ ID NO: 1043 - DNA, 1005 bp, Sulfitobacter sp. NAS-14.1
atgaaactttacatgcaattgatgacaacgaccgcgctggcgctgagcgtcgcggcctgcgggtcatcgaacggggtcgacaaggtgattgatgtgacagacatcaccgaagaggcgcaggccaaacggacctttgctacagacgaggacggtgatccggtcgatgccggtgctgcgattgcgtcaggcaagacactgaccgcgcgcgccgtgggcgtcgccttgcagaacctgaactatcacaccggggaaaccagcacgaccaataatgtcaccgcatcgatcaagcgcaatgatgacggcgcgttgaccgtgaccatcgacggcgaagagctgtcgttcacccctgccgatgtgaatggcgacggtgacggctacgaggtcgaagtggatgggaaattcgcgggcgtctacaactataatggtccggttgaagatctgctgacggcgggcaacggctttgcccaggtggtgcagattttccggtcgtccgagaacgccgaaggtcacgtgtccggcgacagcacctttgcgatctttggcaccgagacggcagatgaagatctgaaagatctgccgaaagccgaatatacgggccggtcgcggatcaatgttgtgccaaacagcggcttcgagtcgaacagcgaaagccggtacaaggtgcgcagcgagatcgcgatgacggcagactttggcgcgggcgagatctggggcaccatcgggaacaccaccatcgaagaccccgaagacggtgtacgtgatgccgttgaggggaccatcgcgatggataaaaccacgttcgacaacaacggttttgccgggacgttgacggctgatgcggatttcatcagcgatatcgacgtcaatagtgccgaagggacgtattccggtgcgttctatgggccaaatgccgaacaggttgccggtgcgctgacatttggtatcggcgctgacgacgggtcgctgaacgggaacggctacttctcggccgacaaagtcgactaa

SEQ ID NO: 1044 - protein, 334 aa, Sulfitobacter sp. NAS-14.1
MKLYMQLMTTTALALSVAACGSSNGVDKVIDVTDITEEAQAKRTFATDEDGDPVDAGAAIASGKTLTARAVGVALQNLNYHTGETSTTNNVTASIKRNDDGALTVTIDGEELSFTPADVNGDGDGYEVEVDGKFAGVYNYNGPVEDLLTAGNGFAQVVQIFRSSENAEGHVSGDSTFAIFGTETADEDLKDLPKAEYTGRSRINVVPNSGFESNSESRYKVRSEIAMTADFGAGEIWGTIGNTTIEDPEDGVRDAVEGTIAMDKTTFDNNGFAGTLTADADFISDIDVNSAEGTYSGAFYGPNAEQVAGALTFGIGADDGSLNGNGYFSADKVD

SEQ ID NO: 1045 - DNA, 705 bp, Sulfitobacter sp. NAS-14.1
atgaaacacgcacgtcttagtattgttattgcaagccttggggcggcaacggtcttgtctggttgcaatggaagcagctccgccggcgggcttgttggcggcgtcgcaggcggcgggcaggattttgaaacagcctttaacgctgtcagtcaaaaggcccccacttcggatatgcccacgtcgctgaaagccagctacgaaggtcagatgaaggtcggcgtgaacagcggatcggcccagattttcggcaccgatatcgatgcgaatagcgcggaaatcattggcgatctggcagtcgatgtggattggaccgacgggcagaccaccaatccgttcaccggaacggcctccaacatcgtcgcgaccgaggcgggcacctcgaactccgtcaaactggacgggacgctgacggtcgatcagggcctgccagcctcactcagccgtaccaccattccggcgcaggtcgtcgcgggcgtcaatatccccgagcagaacaccggcgcgatgctgttccacatgtccggtcggcttagcagtggcaagaacgaaggggacgccaccttgcagttcggcggcaacttcatggggccgggtgcagaatcgatgcttggaccggtatctggcggtatcaacgatgtgaacaatccctcgccgcagattttcgacgcgggcgtcggtggtacattctacgccaacaagaaatag

SEQ ID NO: 1046 - protein, 234 aa, Sulfitobacter sp. NAS-14.1
MKHARLSIVIASLGAATVLSGCNGSSSAGGLVGGVAGGGQDFETAFNAVSQKAPTSDMPTSLKASYEGQMKVGVNSGSAQIFGTDIDANSAEIIGDLAVDVDWTDGQTTNPFTGTASNIVATEAGTSNSVKLDGTLTVDQGLPASLSRTTIPAQVVAGVNIPEQNTGAMLFHMSGRLSSGKNEGDATLQFGGNFMGPGAESMLGPVSGGINDVNNPSPQIFDAGVGGTFYANKK

SEQ ID NO: 1047 - DNA, 2037 bp, T. equigenitalis
atgaataaaaaaatattttatgccagcctcttggcgcttggcttgacggcatgcggaggacgaggcagttttgatactctatcaattaaagaaaatattgacactgttaaaccaggaaagcaaaacaatcaagataataaaccatcagaatcagacgtaataaaacctgaagctaaaggagttatgagaccttcattaggttatgcagttgccgtgcctgtcagggatgtagcaaaacgagacgaatctggtaaatttttggaaccacttactgttgaaggtaagacagtggctcaggaaagagaaatcagaaagcctatagatgattctaaagccataccgcttttagatggtgaccttgagtatatttatattgatggcaaagaaaaatttcctgtagttagagattttgagaaaggtagtaatcagtttgattataagtatgtcagagctggaatcgtaaaacgcaaaggcaattcaacaattgataaatacaatgaaaatgaagatctcatcagcagtcttaataatattgaagcctatgcttattacaaaggatcggaagctgctagtgcattgccaacagataaatctgtagtttatgacgggcattgggagtatatgactgatgctagattgtatagaaacaataaaggcgatgtgcgtaagggaattccagaaggctttaatacaacctcagctcaaggctatgaacatggtgctatgtctatatcacatgaatatagacctttgtttgggtcaaaccaaaaaccagaacaccgaattacaaataatgcccattttgaagttaattttgcagaaaagtcattgaaaggaaaattagatttcggcacacaaactacaagattcacaggcgatgttacatatactcctaaatatgatattgtcgctaaactttatggaaatcgcttcgtaggttctgctttggcacttgatgagccaggaaatgaaattaaagcaacatatgcaaatgcgacaaataagctggagggtggcttctttggacccaaagctgaagaactagcaggtaactttattactgatgataattctttatatggggtatttgcagctaaacaaaaaaatgcttcacaaaatatagagagcgttgttcttgcacagtttcttgatacgacttacggaaaaattaagcagtcagcggatataaaggaagtcactttcgatgaagagggaaaggagacaacaaaacaatacaaaaaagaattggaagatctagatgttcctggagcgcaaacaacgaaaaatctttcactatttgaaaatattgataagttgataatagatggcagagagttgaacttagtgccaggtcgaacagtatccatagaaaaagatggacgcagactgaacgtgacagcttacaaaggggattttgaatatttgcgattaggtaaagtttttaaatctggattcaccaaggttggagaagaggaacaagtagaaagtggagattcagaggaagaagattcaaataaggaaatcacgcaaaaaataactactgtatatccagatcaagatggctattttgtccaaggagccttaacagagtctaaaaatgtgcctaatcaaggtgtagctaagtatgacggtgtgtggggcggaaaaatctactactttaatcgtgcaattggaacaaatcataatactgctcattttgatgttgattttggcgaaagaaaaattaaaggcgacctcaaagactttggagcaaaggtgtttgaaatcgatgcctcaatagataaaaacaccttcacaggtaaggtgacttcagttggcgaaatcaaactcgataatgcagttggaggaactacccatacatcaagtgcaagatttgatattaaggatagggatattgctgtaacaggtgctttctttggtcctaaagcagatgagcttgcaggatcattttcaggaaaaggaaatttaaaaggggattctaacggcaaaacagaagctgatattggagtagttttcggtgctaaaaaaacaaactaa

SEQ ID NO: 1048 - protein, 678 aa, T. equigenitalis
MNKKIFYASLLALGLTACGGRGSFDTLSIKENIDTVKPGKQNNQDNKPSESDVIKPEAKGVMRPSLGYAVAVPVRDVAKRDESGKFLEPLTVEGKTVAQEREIRKPIDDSKAIPLLDGDLEYIYIDGKEKFPVVRDFEKGSNQFDYKYVRAGIVKRKGNSTIDKYNENEDLISSLNNIEAYAYYKGSEAASALPTDKSVVYDGHWEYMTDARLYRNNKGDVRKGIPEGFNTTSAQGYEHGAMSISHEYRPLFGSNQKPEHRITNNAHFEVNFAEKSLKGKLDFGTQTTRFTGDVTYTPKYDIVAKLYGNRFVGSALALDEPGNEIKATYANATNKLEGGFFGPKAEELAGNFITDDNSLYGVFAAKQKNASQNIESVVLAQFLDTTYGKIKQSADIKEVTFDEEGKETTKQYKKELEDLDVPGAQTTKNLSLFENIDKLIIDGRELNLVPGRTVSIEKDGRRLNVTAYKGDFEYLRLGKVFKSGFTKVGEEEQVESGDSEEEDSNKEITQKITTVYPDQDGYFVQGALTESKNVPNQGVAKYDGVWGGKIYYFNRAIGTNHNTAHFDVDFGERKIKGDLKDFGAKVFEIDASIDKNTFTGKVTSVGEIKLDNAVGGTTHTSSARFDIKDRDIAVTGAFFGPKADELAGSFSGKGNLKGDSNGKTEADIGVVFGAKKTN

SEQ ID NO: 1049 - DNA, 750 bp, T. linaloolentis
ttgttcctgctggccgcggcctgcttcggggcggtttatgcgttgttcgtcggctgcctgctgtcgttggggatctgcttgtccttcattgtcaggccgctgctcaggggcattttctggctctggggcaagattacccgtgccgatgtgagacccggttatgagctggctgggttcaattggtttgcgcttcccttcgcgctttttgcggtgttgctcgtgctggacctgggacgggaagatgtaacgctttactggggtcttccgctgctgtccgttgggctctacctgttctattcggcggcaagggatgccggtgtgcgtttccgtcatggagaacgtttgcttgctagcgccattgccatgccggaaaaggacgtattccggcgttcgggagaggtgaacaagtacaagaatgtccagttgatgggtatcgccgtggtggcgttgctgccgcttttcttgagcggagcgttcggctaccttctggaaggcgccatgcgcatggcccaggtgcgcatcgaagcccccgccatctacgtgaaggcaccatacgccacgctgttgccggaggcacttgccagtcgccacccacgcgttccagaaggctatacggcctacatcggcaccacggtgctgttcaagggcttcggcaacatgacggtagtggccttcccggatgcgaacggtacccggcaactggccattcccaacgagcagatcatcgtggagcgccagtctggcggctag

SEQ ID NO: 1050 - protein, 249 aa, T. linaloolentis
MFLLAAACFGAVYALFVGCLLSLGICLSFIVRPLLRGIFWLWGKITRADVRPGYELAGFNWFALPFALFAVLLVLDLGREDVTLYWGLPLLSVGLYLFYSAARDAGVRFRHGERLLASAIAMPEKDVFRRSGEVNKYKNVQLMGIAVVALLPLFLSGAFGYLLEGAMRMAQVRIEAPAIYVKAPYATLLPEALASRHPRVPEGYTAYIGTTVLFKGFGNMTVVAFPDANGTRQLAIPNEQIIVERQSGG

SEQ ID NO: 1051 - DNA, 846 bp, V. cholerae
atgaaaaataaaatatctactattttgggtttagttagtatacttgttggatgtagtagtggaggtcagagtaattataatattccgctagagcagccgttgatagagggtccggtagtggagagtccggtagtggacaaagcagatagcgaggtttttgctgtagacaaaaataacttagaatcgcagatgataggtactatcatatctagagatacatatattgatagtgattttctaaataaaaacagttttgatggtaaaaatgacttatatactgtttcaattgataatgatgaagtatcatttaaagatatagcgaaagataatgaagtaattactgttaaagatataagaaaaatatcatcgaataataatataataggatactatggttatgtactaagttatgcagacaaggaaattctaggtaataatgacaagtatactagatcagattatatttttgcgataaatgccagtgagcaaagaaagcctgaatatacagctacctataaaggcacaattttttatgattatgatggttcagctggtaaagaagcaaatctgactatgttttatgacaacactaaatcaatgttaacaggaacaattgaaggtaattcacaacagggatttaattttttcattaataataagatgcaggagggcaatgtttatgatgatggttcatttattgcggagctaacactgccaaataaaaataatgttgagggtgtaatgtctggtgcattttatggagataaaggccaaacagcggttggaaccgttgagtctattaatgaaaaatcatggggtggagtattcagtgctcaggtagagtaa

SEQ ID NO: 1052 - protein, 281 aa, V. cholerae
MKNKISTILGLVSILVGCSSGGQSNYNIPLEQPLIEGPVVESPVVDKADSEVFAVDKNNLESQMIGTIISRDTYIDSDFLNKNSFDGKNDLYTVSIDNDEVSFKDIAKDNEVITVKDIRKISSNNNIIGYYGYVLSYADKEILGNNDKYTRSDYIFAINASEQRKPEYTATYKGTIFYDYDGSAGKEANLTMFYDNTKSMLTGTIEGNSQQGFNFFINNKMQEGNVYDDGSFIAELTLPNKNNVEGVMSGAFYGDKGQTAVGTVESINEKSWGGVFSAQVE

SEQ ID NO: 1053 - DNA, 729 bp, V. fortis
atgaaaccagttcaactttcatggatcgcggctgcaatgattggccttagcccacttgttcaagcaggttttgatggcgcgattagcgacgactctctacgccaagttggtgaatctgaagtttacgtcccactgtttcactcgaaaggtaaagccggcattggcagctcaacaggtaagcgtgtcgatttcgatggtctagctaacagctttttcagtgctgatccacgcgatggcgttcatacttctggcagtaaacactttggctcaacgcactacaactttgcgcaagcggctaaccaagacgtttggtttggcgaatggtatgaagggaaacaagatgaaacatacaacaaccgtactgtttactatgtaggcgacaacactggtaccactgtacctacctcaggtagcgcgacgtacaacattactggtattaaccactttagcggtaataacaaactgtcaggtacgtttactgctgatttcgctcaacaaacactaacaggcgacattgctaatgcgtctctatctatcaatgtggatagcacgattgatgcagcaagcgcttcgttcaatggtacggcaacagctaaccaagcaggtgtgacaactcaaggtatttctcaaggtcacttctttggcgcagatgcagcaacacttgctggtattgcgacttttgctggcaactctgatcttgatactgcattcggcggtgcaaaacagtaa

SEQ ID NO: 1054 - protein, 242 aa, V. fortis
MKPVQLSWIAAAMIGLSPLVQAGFDGAISDDSLRQVGESEVYVPLFHSKGKAGIGSSTGKRVDFDGLANSFFSADPRDGVHTSGSKHFGSTHYNFAQAANQDVWFGEWYEGKQDETYNNRTVYYVGDNTGTTVPTSGSATYNITGINHFSGNNKLSGTFTADFAQQTLTGDIANASLSINVDSTIDAASASFNGTATANQAGVTTQGISQGHFFGADAATLAGIATFAGNSDLDTAFGGAKQ

SEQ ID NO: 1055 - DNA, 1380 bp, V. fortis
atgcatggctatacttacaagtttccaataattctctctttcgctttcattacggcgtgtaatgaaagcgcttctgattcatcgccgacaagcgatccgaataatcaaactccgatcgctatcgctggtatcaatcaacaagttaaagttaatcaagtcgtccacttagacggcacgcgtagtgttgattatgacaacgacttcatctcttattcgtggtcattctcagaaaaacccgcaggtagcgaagcacaactttccagcttggaggccatcaaaccgactttcgttgcggatcagattggtacgtattatctctcgttggtggtcaacgatggccaagtcaacagtcgcccaaatcaagtgaaaatagtggctaaatccaaccaagacaactcgccaccggtggtctctcttaccccaacgtacagcgcatccctgtctcaatccgttaagctgtttgacacatccacagatgctgacggcgatgagctttaccgtcaatggaaaattatcaaccagccagacgagagtcagcctagtctcagtaaatatgagggcaaataccccgacttaaccgctgatgtggcgggtgactatgtggtggaattaaccgtcaccgatggtttcttatcgaccaaggcgaccacaaccgtcacctttaatgaaaaccatcagaaccgacctccaattgcttataaaaaccagcacatgttagccattgaaggtatgacgatccctctagatgccagtgtaagtactgacccggacggcgatccactcacctttaattggttttttgtgtcaaaaccacaagggagcaacgctactatcgctgatcctaatgcggtaatcacaagttttattgccgatgtgagcggacaatatactttcaatatcgaagtaagtgacggtgagttcaccgatttaggttacaaacccacgtacgtaaatgtggcttcgttaaatggcccgcacgcaaaagtctttctgagagatgaaaccgaacctttacttctaccctttgatgaagataagaacatagatctaaccaatgataccggagaaatacctgagtactacactttaggatcctttacgtttgaagccgtcgaaaaagacattactcttaccgtgacttccttgactgatgttaaagacatcgtacagcccatcataagaacctcttttggtgagctcgctgaatctgatgtttatgtgattccagcaggtacccgtgaaaccctaactttgtattcacctccaacccagagcaaacccactcgagttgttctcggatttgcgtggagtttaaatggacccaacgatttctcgtatatagagcgtgctggcggtaactacaatttcatgagtcgataa

SEQ ID NO: 1056 - protein, 459 aa, V. fortis
MHGYTYKFPIILSFAFITACNESASDSSPTSDPNNQTPIAIAGINQQVKVNQVVHLDGTRSVDYDNDFISYSWSFSEKPAGSEAQLSSLEAIKPTFVADQIGTYYLSLVVNDGQVNSRPNQVKIVAKSNQDNSPPVVSLTPTYSASLSQSVKLFDTSTDADGDELYRQWKIINQPDESQPSLSKYEGKYPDLTADVAGDYVVELTVTDGFLSTKATTTVTFNENHQNRPPIAYKNQHMLAIEGMTIPLDASVSTDPDGDPLTFNWFFVSKPQGSNATIADPNAVITSFIADVSGQYTFNIEVSDGEFTDLGYKPTYVNVASLNGPHAKVFLRDETEPLLLPFDEDKNIDLTNDTGEIPEYYTLGSFTFEAVEKDITLTVTSLTDVKDIVQPIIRTSFGELAESDVYVIPAGTRETLTLYSPPTQSKPTRVVLGFAWSLNGPNDFSYIERAGGNYNFMSR

SEQ ID NO: 1057 - DNA, 1323 bp, V. fortis
atgacttcaaaactaaaatggaccttacttgctgccgctatgccagcgcttatcgcatgcggtagtgggagcagcgacagcagttcagactcttcaaacaacgcaactgtagaaaaatcttatgccaaactaggcaagcgtgtgcgcttagatgtaacccaaggtttagatacctacaacgaaaacatgactttcgaatggaaggtcacaagcaaacctgatggcagtaacgttgcacttaacgcaagcaaggccatttcaccttatttcactccagatgttgttggtgattacacatttgaactagaaagtgcagtatctggcacttcaagtaccacaaagcaaaccattgaagtcactgacgcatcacaaaacgtggcgccaatcatcgatattgcgacaccaccaagtgttgctctagccaaatctatcgaaattccgtctaacgccgtcgaccttgatggcgatgttttaacttatcaatgggcgcttttatcaacaccggataatgcgacaatgaaacttacgggcagcggagcatcaacagcagtactactttctaatacagccggtgactacaaactgaaattaacagtaagcgacggttacgagagcgctagccaagaagtgactgtgtcatattcagcagaaaacattgctcctgtggctaatgcgggtggcgtaaagtctttagagattagagaaacagcaaccttagatggcagcggcagctacgacggcaatgaagatgcgattacgtacacgtggaaactactttctaaacctgaaaatagtacagctgagctttcagactctacagtcgcgaaacctgatttcacacccgaccaagtgggtgattacctcttctcgctaactgtaaatgacggtgaattaaccagtgaagccgatatggttcgcttgagcgcaagtgccacaggcagcagcgaaatcatctttacctttggagatgaaaaaacaatacatgccctacctttcgctattccgcctattaccttagataaaaccatcacaggtgatgcacccgattacgttctagtgggaacttatactctagaggcggttggtaaggactacacaatcagtgaaattactgaaatggacttcagaggtgaagattatgcaccgaaaatgacagggatagaactaaaccaagtcctacatgcaggggatgtggcttacgtgaaaatgtgggcaaaaccgacgaatggcgcgcgaaccaacgttgtatattcgttcatccttgatagtgatttcacaaactacatgggcgttgcttacgacttaagtgctgaggcgaactaa

SEQ ID NO: 1058 - protein, 440 aa, V. fortis
MTSKLKWTLLAAAMPALIACGSGSSDSSSDSSNNATVEKSYAKLGKRVRLDVTQGLDTYNENMTFEWKVTSKPDGSNVALNASKAISPYFTPDVVGDYTFELESAVSGTSSTTKQTIEVTDASQNVAPIIDIATPPSVALAKSIEIPSNAVDLDGDVLTYQWALLSTPDNATMKLTGSGASTAVLLSNTAGDYKLKLTVSDGYESASQEVTVSYSAENIAPVANAGGVKSLEIRETATLDGSGSYDGNEDAITYTWKLLSKPENSTAELSDSTVAKPDFTPDQVGDYLFSLTVNDGELTSEADMVRLSASATGSSEIIFTFGDEKTIHALPFAIPPITLDKTITGDAPDYVLVGTYTLEAVGKDYTISEITEMDFRGEDYAPKMTGIELNQVLHAGDVAYVKMWAKPTNGARTNVVYSFILDSDFTNYMGVAYDLSAEAN

SEQ ID NO: 1059 - DNA, 750 bp, V. nigripulchritudo
atgaaaccagtaaaactgactcttatttctgctgcactacttggcttaagctcaatggctcacgcaggttttaacggcgcaatcagcgacaacactcaccgccacgttggcgaatctcaagttgacgcatcactattcttcggcaccgtaatcatccatgaaagtggttacgcgggtatcggtgccacaggaaaagaacgtgttgatttcaaaaacctggcgaagcgttcctcatggccgtttggtgtaacacgtgaaggtatacatactcgcggaagccgccactctacaacttctcaatacaactttgccagcgttgcaagtcaggacgtttggtttggtgagtggtacgaaggcagccgtgactctggctacgcaaaccgtgcggtattctacgtaggtgataacacaggtactacagtaccaacaactggaacagcaacttacagtgtagctggcgtaaacaaattcaacggttcgaacaaacttagcggtacttttacagctaactttggcactcaaaaactaactggttctattaacaatgcctctctgactgttggtgtaaacgcaaacatcaatgcttctactgctgcatttaacggtacagcaacagcaacaactggtggtgcgactacaaacggtacgtctcagggtcacttctttggtgcaaacgcatctgctctggcaggtattgcgaccttcactaacaaagacctagacacggcatttggcggcagcaaaaactaa

SEQ ID NO: 1060 - protein, 249 aa, V. nigripulchritudo
MKPVKLTLISAALLGLSSMAHAGFNGAISDNTHRHVGESQVDASLFFGTVIIHESGYAGIGATGKERVDFKNLAKRSSWPFGVTREGIHTRGSRHSTTSQYNFASVASQDVWFGEWYEGSRDSGYANRAVFYVGDNTGTTVPTTGTATYSVAGVNKFNGSNKLSGTFTANFGTQKLTGSINNASLTVGVNANINASTAAFNGTATATTGGATTNGTSQGHFFGANASALAGIATFTNKDLDTAFGGSKN

SEQ ID NO: 1061 - DNA, 1368 bp, V. nigripulchritudo
atgataaagctgacccaaatcctgagcttagcctttacagcggtcattcttgcgggatgtaatgaaagtctgaaactcgatctggcatctaccaagtcgaatacccctcctattgctatcgcgggtaccaatcaactggtttatgtgggtgagccagctcaactgaatgggaaaaaaagcttcgataaagaccttcagccgctgacctttgaatggaaaatacaacctgatcaatacacgcagctggatcgtaacgccaagctccttcaaccaaattcaattaaaccgtcgttcgttgcccatgaagcgggagagttctacatagacctgacggtcaatgatggcattgaaaacagccgggtaaacaccatcaagctcactgctataattaaaggggcaaacagcccaacagttatcatattaaatgaaattattgaaggctctttgcaacacggagcttccattagaccaagctatgaagacgccgataatgatgagctgttttatacatgggaaattttagaaaaacccctaaatagctccccaaccattgaaaatactaattccacatacggttggggtagcctcaaaacagatgttgaaggggattatttgatcaagcttaccgtattcgacgggacacaccattcgtccgctacgacaacggttcaaattcgctatgttgatacaaacgcaagaccctatgccaacctagatcctgatgtatggataagttttgtaggaaactcagtcactcttgatggaacaaagagctcagatgcagatggagacccattaaactaccactggacaatgacgccaccaaatggttctaacgcgacctttgatgaccctagttcagccacgccaactgtaactggtgacgtaccgggcatttacttctatgaattggtagttgacgatggtgaattgtttagcattcctaatgagcaagcactggaatttctcgcgccaagttcaccaggcttacgaatctaccacagcaacagctcttctccggtagatatgccgcatagccccgaccaaaccataatcgaaacacaaagtaatagtacatactatgttctaggtagctatcgcattgaagcagtgggagctgatgtgtacatcagagatgtggttgccagtgacagggccaatattatcaccccttattttgatggcttggagcaaactcaattattcacactaaaaaaaggtgagagcatatcttttaacttggtatcccctgccactggcggaaaaacaagccagcccatatttagctttaactggataatggggcgcgctacggactaccacaatgcctatcactttgacgctaaatatactttcaccagtaattaa

SEQ ID NO: 1062 - protein, 455 aa, V. nigripulchritudo
MIKLTQILSLAFTAVILAGCNESLKLDLASTKSNTPPIAIAGTNQLVYVGEPAQLNGKKSFDKDLQPLTFEWKIQPDQYTQLDRNAKLLQPNSIKPSFVAHEAGEFYIDLTVNDGIENSRVNTIKLTAIIKGANSPTVIILNEIIEGSLQHGASIRPSYEDADNDELFYTWEILEKPLNSSPTIENTNSTYGWGSLKTDVEGDYLIKLTVFDGTHHSSATTTVQIRYVDTNARPYANLDPDVWISFVGNSVTLDGTKSSDADGDPLNYHWTMTPPNGSNATFDDPSSATPTVTGDVPGIYFYELVVDDGELFSIPNEQALEFLAPSSPGLRIYHSNSSSPVDMPHSPDQTIIETQSNSTYYVLGSYRIEAVGADVYIRDVVASDRANIITPYFDGLEQTQLFTLKKGESISFNLVSPATGGKTSQPIFSFNWIMGRATDYHNAYHFDAKYTFTSN

SEQ ID NO: 1063 - DNA, 1536 bp, V. nigripulchritudo
atgaacaacaaaaatacatggatgcttctggctttgagtctgccgacattagtcgcatgcggtggcggttcgagctccaacgattccaacggttccaacggttccaacgacaacacagtaaaaccacctgtcgttgcaccagcaccagcaccagcaccagcaccagcaccagctaaaaaaccacaaatcaacgccaagatgaacaacactgttcatctaaatggtttggatattttcgctcaggcagctcagaaaaaagcactgaactcggcagtagctgacactgcaaacactcaaccattcacttgggtcattagcaaaaaaccagcaggcagcaacagtgcaattaaaaacgccaatgcattagtgacgtcgttccaaccagacctggcgggtgaatacaccattcagcttaccgcaacgaatcctgcagcgacgatagaaaaacactataaagtgacaggtgccgctgagaacgcagcaccaaatgtcttcccagtcgagtcagtaatgacgcgaatcgacacgaacattactctgtcagcaaacgctgaggatccagacaataacgctctgacttaccagtggtctgtggcaaataaacctagtaatgcaacggtaacactaactaatgaaacgacagaaaatgccacattctctgccaatgcagcaggtgagtatgagttaagcattgcggtttcagattcaaaagagacagtaaagcgtgcagttactgtgaagatagatgaaagtgtagtgccttacacgtctgagacgtctgtttatttagaaagaaccaacgcctttacccaagaaaacgtaaaaccaatcaataaactgaactttgcgacgcttgagttaaataagaaggtaaaattggatgccagctcgaacacagacaaagacagcacaaatttccaataccaatgggcggttgtttctaaacctactgcaagctcaggcacaatcacactagattcggcgcaagttgccgaatttactccagatgtaattggtgattatgtcttttctgttacggtaaacgaaggcaataagcaacgtgctattgaatatgtgggtataacagcggtagaaaatgtaacatcagcaactgctcttatcagtgtggtaaactctacaggattgacttatacctataaatcttccaattacattccagaaggcgacccgaggtttaattatgtagaagaccctatgtatggaagacacaaagtcattgctgtttccaaaaacggagcttcaactgattatattaaagttgattccattaccattacgccaactgtagcagatgtatttgtctttgactttgtaaccgtgaatactccaccacctgtatcgggaattaaattcgaaggaatcaaaaagaatcaattaatttcagtgggagaatcggtagtttttgatgtttatatggatgcttcgcttccattaaataagttcacagaaatagctatcgatttttctggaagatatacccattccttctcaaatatttatgcgtttacagagtaa

SEQ ID NO: 1064 - protein, 511 aa, V. nigripulchritudo
MNNKNTWMLLALSLPTLVACGGGSSSNDSNGSNGSNDNTVKPPVVAPAPAPAPAPAPAKKPQINAKMNNTVHLNGLDIFAQAAQKKALNSAVADTANTQPFTWVISKKPAGSNSAIKNANALVTSFQPDLAGEYTIQLTATNPAATIEKHYKVTGAAENAAPNVFPVESVMTRIDTNITLSANAEDPDNNALTYQWSVANKPSNATVTLTNETTENATFSANAAGEYELSIAVSDSKETVKRAVTVKIDESVVPYTSETSVYLERTNAFTQENVKPINKLNFATLELNKKVKLDASSNTDKDSTNFQYQWAVVSKPTASSGTITLDSAQVAEFTPDVIGDYVFSVTVNEGNKQRAIEYVGITAVENVTSATALISVVNSTGLTYTYKSSNYIPEGDPRFNYVEDPMYGRHKVIAVSKNGASTDYIKVDSITITPTVADVFVFDFVTVNTPPPVSGIKFEGIKKNQLISVGESVVFDVYMDASLPLNKFTEIAIDFSGRYTHSFSNIYAFTE

SEQ ID NO: 1065 - DNA, 729 bp, V. splendidus
atgaaaccagttcaactttcatggatcgcagcagcatttcttggtctaagccctgtcgttcaagccggttttgacggtgctatcagcgacaattcacttcgccaagttggtgaatcagaagtttatgtgccatttttccactcaaaaggcaaagcaggaatcggcagtgctactggtaaacgcgtcgacttcgacggcttagctggaaatattttcagcagtaaagagcgagacagtgttcatacatcaggcagtaaacacttcagtaactctcactacaattttgtacaagttgcgaaccaagacatttggtttggggaatggtatgaaggcaaccaagacgcagatttcaataaccgaacggtttactacgtagggaacgatgcaggcacaactgtaccaactaacggtactgcaacttacaacatcaccggcattaataagtttagtggcagcaataaattgtctggaacatttgatgctgatttcaataaccaaactttagagggtagtatctcgaatgcaaccctaactgttggtgtgaatagcactattgactctgcaacggcgtcgttcaacggaagtgcaaccgcgacacaagctggttctgtaacccaaggttcgtctcaaggtcacttcttcggtgcggatgcggcttcccttgctggtatcgcgacattcactaacaatagtgatcttgatactgccttcggtggtgaaaagcagtaa

SEQ ID NO: 1066 - protein, 242 aa, V. splendidus
MKPVQLSWIAAAFLGLSPVVQAGFDGAISDNSLRQVGESEVYVPFFHSKGKAGIGSATGKRVDFDGLAGNIFSSKERDSVHTSGSKHFSNSHYNFVQVANQDIWFGEWYEGNQDADFNNRTVYYVGNDAGTTVPTNGTATYNITGINKFSGSNKLSGTFDADFNNQTLEGSISNATLTVGVNSTIDSATASFNGSATATQAGSVTQGSSQGHFFGADAASLAGIATFTNNSDLDTAFGGEKQ

SEQ ID NO: 1067 - DNA, 1395 bp, V. splendidus
atgcacattaattttcattgggcacccatcttattgtttgctgcgctatcaacaggctgtaacagtggtggggatagcaacactccaagtaccgacccaggtttacagaacaaccagagaccgattgcgattgcaggcataaatcagcaagtgaaagaaggcgatcgggtacaactcgatggaacctcaagcattgattatgataaagacgaaattacctatcaatggtctttgagttcaaccccgcttcaaagcctagcggaactgtctcaggtcgatgcaatcaagcccacatttatagcagacaagttaggaacctatgttgttgatcttgtcgttcatgatggaaccaccagcagccgaaccaaccaagtaaaagttgttgcggtttctgatggagaaaactcaccaccgacggtttcgatatctcgggaccattatcgtgctaatctaattgattttgttacgatttttggcaaggcaagcgatgctgacgatgacgatgacgagttaatatatcgctggaaaatcatacaacaaccagaaaacagtaacccaagtctggataatacttcttctaaatatccaaggttaacgacagatactatcggcgattacattgtggagcttactgtatccgatggtttagcatccgccagtgatacagccactgtttctttctactatgagaacgtcccaccaattgttagagggacaggaagccctatcggtgccattgaaggcatgaccattccattagacgcaagtacaagcgaagatccaaatggtgacccgatcactttccaatggtcattcatctcaaaacctcaagcatcaaacactgtcattgttaacccaagctcagcaaaacctcattttttagcagacgtagctggtgactatggcattactgtcgaagtcagtgatggagagttgtcatcatttccatcaaaagctgcctatgtgcgcgtggcttcgctgacgggcccccatgcaaaggtaatgattgatgatgaccccaaccctgttctattaccgtatcgcaatacatggaccattgataagacacaagatagcggtgacctcccagactattatgaactgggcacttatacatttgaagccgtaaccaatgacatcactctaacggttagtaccctccgagatcgatcgaatactgtacaaccaatagctcgaacgccctttggtgatttaaaggaaagagaaatatacgttattcctgctggcacaaaagaagtcattacaatcctttcccctccaacttcaggtcaaaccacggatatagaccttgattttgcctggagcctctacggcttgggtgattacagtccaatccgaagagctggtgggaattacatattcactagtcgatag

SEQ ID NO: 1068 - protein, 464 aa, V. splendidus
MHINFHWAPILLFAALSTGCNSGGDSNTPSTDPGLQNNQRPIAIAGINQQVKEGDRVQLDGTSSIDYDKDEITYQWSLSSTPLQSLAELSQVDAIKPTFIADKLGTYVVDLVVHDGTTSSRTNQVKVVAVSDGENSPPTVSISRDHYRANLIDFVTIFGKASDADDDDDELIYRWKIIQQPENSNPSLDNTSSKYPRLTTDTIGDYIVELTVSDGLASASDTATVSFYYENVPPIVRGTGSPIGAIEGMTIPLDASTSEDPNGDPITFQWSFISKPQASNTVIVNPSSAKPHFLADVAGDYGITVEVSDGELSSFPSKAAYVRVASLTGPHAKVMIDDDPNPVLLPYRNTWTIDKTQDSGDLPDYYELGTYTFEAVTNDITLTVSTLRDRSNTVQPIARTPFGDLKEREIYVIPAGTKEVITILSPPTSGQTTDIDLDFAWSLYGLGDYSPIRRAGGNYIFTSR

SEQ ID NO: 1069 - DNA, 1344 bp, V. splendidus
atgaagtcgaactttaaatggacattacttgctttaactattccaactttaatcgcatgtggtggaggcagttcaagctcaagctcaagttcaacacccgcagcgcaagatcctttgggtttagcggtgatctccgcgcaaagtgtcgcgaaggttaacagtcgagttcgagttgatgggcttcagagtgaaggattagatggagaatctcttagctaccaatgggaaatcagtaataaaccggaagggagcacagcttcacttaataacgccaatgctgtctctccatacttcactccggatatagctggtaactacaccttagatttggtcacaaaaagtggtagtaaagacagtgaaaaagtctcttatgtaatcgatgtaagtgatgcgagcactaatacgcagccgattgtcgatctagattttcctgacagtgtcgctattggtaaaaccgtcgatctacattcacaagcttatgatgcagacggtgatgtgctgacttaccaatgggcactactttcatcgccaagtaatgccacaatgaaattaacaaacagtgccactccaacagcaaatctcctttccaacactgccggagattaccaattaaagctaacagtgagtgatggctacgaaacaatatctgaagaaatgactgtttcatattctgctgaaaatgtagcgcctaaagctagcgtaaaaaacaagcaaacatttgaattaggtacaagtgcactgcttgacgcaacagcaagtactgacggaaacgatgaccaaataacctacgaatggaaagtggtttctcaaccagaaaacagcacggcaacgctaagtagcacaacagatgaaaaaccgaattttacccctgatttaattggcgactatgtattgtcccttaccgtttctgatggcgaattaaccagtaaaaaagagtacattcgtttatctgcaacagaagtcggaaccagtgaccttattcttaagtatgcggaagataccacggctagagtatggccatttgctgaacaattcacttcgaatatttcgactacgggcgatgcaccagctcatgttctactaggcacttttagccttgaagctgtaggtaaggactatacaattaatgagacaaccgctatcgattatattggtaatgttgatgcggtaatgacaggaatgaatgctggtcaggtactaaatgctggcgataaaattaacgtaaaaatgtgggcagagccaacccaaggtcaattatcaatgatttcatatggtttcattgttgatacaactttagagcaatatatgggactggggtatatgtatacttcaacggctgaataa

SEQ ID NO: 1070 - protein, 447 aa, V. splendidus
MKSNFKWTLLALTIPTLIACGGGSSSSSSSSTPAAQDPLGLAVISAQSVAKVNSRVRVDGLQSEGLDGESLSYQWEISNKPEGSTASLNNANAVSPYFTPDIAGNYTLDLVTKSGSKDSEKVSYVIDVSDASTNTQPIVDLDFPDSVAIGKTVDLHSQAYDADGDVLTYQWALLSSPSNATMKLTNSATPTANLLSNTAGDYQLKLTVSDGYETISEEMTVSYSAENVAPKASVKNKQTFELGTSALLDATASTDGNDDQITYEWKVVSQPENSTATLSSTTDEKPNFTPDLIGDYVLSLTVSDGELTSKKEYIRLSATEVGTSDLILKYAEDTTARVWPFAEQFTSNISTTGDAPAHVLLGTFSLEAVGKDYTINETTAIDYIGNVDAVMTGMNAGQVLNAGDKINVKMWAEPTQGQLSMISYGFIVDTTLEQYMGLGYMYTSTAE

SEQ ID NO: 1071 - DNA, 1317 bp, Vibrio sp. HENC-01
atgaaacccaacatgaaatggacgcttcttgctatcaccattccttcgcttatcgcttgtggtggttcagactcaaacactgcagattcacataaagcgcctgtatccgttgtctcaggttacgaaacagcaaaagtcggaaacagaattcgtgtagatggactgggtagctacggtgtagatgccagtatcgcaacgtacacttggtctatcagcaaaaaaccacaaggcagtaacgtcaagttaaataacgttaatgcagtctctccatacttcacaccagacgtggcaggagactacaccgttcagttggtaaccaacgatggcaaaaaagacagtagcgcacaatcgctgactatcaccgcaacagaagtaaataccaacgtggcgcccgttatttatgcatcggaaacctacacggcagcgcttgatcaaaccctgaaattagacgcgaaagcttacgacgctgataatgatatgctcagctaccaatgggctcttaactcagcaccaaaaaacaccacgatgtcgttgagcaacgcaagcaccaaacaagcagcgctaaaagcaaacgttgcgggtgaatacaaactaactctaaccgtctcagacggtaaagaagagacaactaaagagatcaccatcaactactctgccgataacgtagcaccggttgccatggcaggacgagataccacattcgaattgggtggaaccgcaaccttagacgctagcgcaagcattgatggcaatgattcaggtatcacgtaccagtgggaatttgtgtccaagccttcggcaagtactgcagaattgtcggatgctacgtcagcaaaaccaacattcacccccgatgtcgagggtgattatgcgcttgctctaaccgtaagtgatggtgctctaagcagtgaaaaagattttgttcgagtaacggcatcgaaagcaggaacaagcgacctcgtattgcacttcaacggtgagaaaaaacgatggccgttcgcagaagaggttactctgaatgaagaaattaaaggtgaagcgcccaaatacgtactcctagggtcattaactcttgaagccgttggacacgattatgaggttcagcagatctttgcaatggacgcagtcagcctcactcacgacgttaaattaagcggcattgaagatggtagcgtgctacctgtcggcgatgaaatagttgttaagctttggtcggcgccaacgcaaggaaatactgttacattgtcttacggttttatgatcaaagatcaaacaaacttttatgcaggtcttggctaccacttccaaacaaactga

SEQ ID NO: 1072 - protein, 438 aa, Vibrio sp. HENC-01
MKPNMKWTLLAITIPSLIACGGSDSNTADSHKAPVSVVSGYETAKVGNRIRVDGLGSYGVDASIATYTWSISKKPQGSNVKLNNVNAVSPYFTPDVAGDYTVQLVTNDGKKDSSAQSLTITATEVNTNVAPVIYASETYTAALDQTLKLDAKAYDADNDMLSYQWALNSAPKNTTMSLSNASTKQAALKANVAGEYKLTLTVSDGKEETTKEITINYSADNVAPVAMAGRDTTFELGGTATLDASASIDGNDSGITYQWEFVSKPSASTAELSDATSAKPTFTPDVEGDYALALTVSDGALSSEKDFVRVTASKAGTSDLVLHFNGEKKRWPFAEEVTLNEEIKGEAPKYVLLGSLTLEAVGHDYEVQQIFAMDAVSLTHDVKLSGIEDGSVLPVGDEIVVKLWSAPTQGNTVTLSYGFMIKDQTNFYAGLGYHFQTN

SEQ ID NO: 1073 - DNA, 1413 bp, Vibrio sp. HENC-01
atgagtctaagctcgaaatatactctcacaccattgctattattacttcttaatggttgtaatggtggcggtgggaatgatgcctctgaaccccaaacgcctaacaatcacccccctattgcgatagctgggatcaatcaacatgtaaagctgagtgaaaaagtggtgcatctcgatggcacgggtagcgtcgactacgatcaagactcaatagccttctcttggaaaatggtatcgaaacccttcaagagtaaagcggagctcattaatccagaatccagaactccgcgctttgagccagacttattgggcacttaccttgtagaattggtggtgaacgatggcaaaacagacagccgccctaaccaagtaaagatagaagtcatcagggaagacgaaaatacaccaccaacgattaaatttaccaaagataagtacaccggtaacctaactcagcaaattaacctaaacacaagacctcaagatattgatggcgataaattgtcgtttacatgggaagtgttgtcccacccacaaggcagcaattactctatagcgaaatcgactgtgtatgatttcaactcaatcaaggctgatacggagggcaattatgtggttaaagtgactgcattcgatggcttttctgaagcttccgctacgaccaccgcttcctttttttataaaaatgtccctccacatgcggaggtagatggttcaatgttttgggttcttgataacatgagtgtcccattgaatggcacacccagtggtgatgccaacggcgatgtactcacttatgaatggcacttcactaaaaaaccaaacggctcatccgccgtcatcgatgatccttatgctgtgctaacttcattttcgccagatatctccggggattacgtcgtcagtttaaccgtaaatgatggcgagttttcagatagccattctgtgggagttagagtaagagcgatttctgaatcccaaccgcacaccaaactcacacgcggctcagataccactcctttgcgactgcctcacaagcaaaatgacgtcatcgataaaacatccgatacgggtcctattcctaactattacactctcgatagctatacttttgaagcagtaggaaagccaatcaccattactctcggaaagtatacgcttagtagtagcagcgacgatgtaacaccaaggatattagttggctctcaaagctactttagtaaagacctccaagataacgatgttattattgttatccccgctggtgacagcttaaccttccaactacaaagtccaccgaccaacggcaaagtggcaaaagcctcaatgggcttcagctggagtcttaacggtcctaatgactttagtatggttgaaagaatttccacaacgattgaatttaccagccgttaa

SEQ ID NO: 1074 - protein, 470 aa, Vibrio sp. HENC-01
MSLSSKYTLTPLLLLLLNGCNGGGGNDASEPQTPNNHPPIAIAGINQHVKLSEKVVHLDGTGSVDYDQDSIAFSWKMVSKPFKSKAELINPESRTPRFEPDLLGTYLVELVVNDGKTDSRPNQVKIEVIREDENTPPTIKFTKDKYTGNLTQQINLNTRPQDIDGDKLSFTWEVLSHPQGSNYSIAKSTVYDFNSIKADTEGNYVVKVTAFDGFSEASATTTASFFYKNVPPHAEVDGSMFWVLDNMSVPLNGTPSGDANGDVLTYEWHFTKKPNGSSAVIDDPYAVLTSFSPDISGDYVVSLTVNDGEFSDSHSVGVRVRAISESQPHTKLTRGSDTTPLRLPHKQNDVIDKTSDTGPIPNYYTLDSYTFEAVGKPITITLGKYTLSSSSDDVTPRILVGSQSYFSKDLQDNDVIIVIPAGDSLTFQLQSPPTNGKVAKASMGFSWSLNGPNDFSMVERISTTIEFTSR

SEQ ID NO: 1075 - DNA, 726 bp, Vibrio sp. HENC-01
atgaaaccacttcaactttcatggattgcagcagcaatgattggtctaagcccacttgttcatgcaggatttgatggcgcgatcagtgatgattcgcttcgccaagtaggagaatcagaagtttgggtcccatttattcactctaaaggcaatgcaggcatcggtaaaacaggtggcaaacgagtggactttgaaggtctagctggtggtatttttgatgacgagcgaaatggtgttcacacatcaggcagcaaacattttcaagacaatttttacagttttgtccaagtagcgaatcaagatgtgtggtttggagaatggtacgaaggtaagaaagattctgagtttaacaaccgtaccgtttactacgtcggtaatgatgcaggaacgactgtaccaaccagcggcaaggcgacctacaacattactggtattaacaagctctctggcgcaaacaaactttcaggtacgtttaacgctgatttcggagccaaaacgctagacggttcaatcaacaatagcaacctaacggtaagtgtagacgcaacgattaatgcagcaaccgcagcatttaatggcgctgctcaagctgtacagaatggcacaaccacgaatggcgcttctcaaggtcacttctttggtgcgaatgctgctggcttggctggtatcgccacctttaccaacaatagcgatctagacactgcttttggcggcgagaaaaaataa

SEQ ID NO: 1076 - protein, 241 aa, Vibrio sp. HENC-01
MKPLQLSWIAAAMIGLSPLVHAGFDGAISDDSLRQVGESEVWVPFIHSKGNAGIGKTGGKRVDFEGLAGGIFDDERNGVHTSGSKHFQDNFYSFVQVANQDVWFGEWYEGKKDSEFNNRTVYYVGNDAGTTVPTSGKATYNITGINKLSGANKLSGTFNADFGAKTLDGSINNSNLTVSVDATINAATAAFNGAAQAVQNGTTTNGASQGHFFGANAAGLAGIATFTNNSDLDTAFGGEKK

SEQ ID NO: 1077 - DNA, 714 bp, X. doucetiae
atgaaaaagatcaatatattcattgccatgttaggcatttttggacttatcacacaggttcaggcaaaagttgcgtatggtataagccaacaagaaactgacccacatcttctcatcggagaggtagatggtgaacccggtttaggtatcactttaccaataacagggaataaattattttctgcctcttacctgaaaaagttagctacacgcgataataatggtgtttatcgtttcaaactggagaataatcctattgctgagaaccaatatctcgacatctttcaaattcccaatacggatatttactttggggaatgggcacaaaaaacgcctgataaatcggatattacccacactgttttttatgcaggtaaagatgtgacaaccaatctgccaactggcggcactgcgacctatacagtaacaggacttaaccgatataacgataacaatctcctctctggtaaattcaccgcagactttggtaacaaaaaactgaatggttcactcagtaatgactcattaaatatcgatattgatgccaatataaataatgatgccggattttcaggtaaagccacggccaatggaaatattaacggcgtcaccgatgggaaattttatggtaattccgcctcctctctggcagggtatgccaaatttgctagtgacagaaacaaagatacggctttcggtggtactaaacagtaa

SEQ ID NO: 1078 - protein, 237 aa, X. doucetiae
MKKINIFIAMLGIFGLITQVQAKVAYGISQQETDPHLLIGEVDGEPGLGITLPITGNKLFSASYLKKLATRDNNGVYRFKLENNPIAENQYLDIFQIPNTDIYFGEWAQKTPDKSDITHTVFYAGKDVTTNLPTGGTATYTVTGLNRYNDNNLLSGKFTADFGNKKLNGSLSNDSLNIDIDANINNDAGFSGKATANGNINGVTDGKFYGNSASSLAGYAKFASDRNKDTAFGGTKQ

SEQ ID NO: 1079 - DNA, 849 bp, X. nematophila
atgaatacaaaatctaaaatctatttagctctcgcactggtactttctgttacagcctgttctagaggagggggttctcaccacggtgtcagtggtgaaacaggtaagcagcctggatataaagagaggccgcttttgccctctgattatccatcacaaagcaaacaaaacaccgtatcgggccttaagggatattccaacggcagtttctctaattatgtgtatacgacccttactaattcccctgaagcgggtgcaaacccagcccccctgagcaagtattactacctccatataccaggtgagggtgataattatgtcccgatacaagtgtcgaattttacggttggtggagattatgatatgtcatttatggcccaaaacaagaaggcagtgataggttcttccaataagcggatataccttgcgacggatcttaataatttaaggccatacaccggatcagtgaataaagctacttttagcggtctggctcgtcacagtgaaaacggaaaacttagtattttgaaggtggttatggacgccacgttcggaggtacgggggagaatggagaaatgtttgcccagatgaaggggagtcttcagaaaaatggtaaagactgggctccattcgaaggatatacccctataatgaacggcatgagtacaatgaagtttaccggcgatgcaccagaaggactgcgaaagggagatctaacgggttacttctctgacccggaggctggtgcttttactggaacatataattctaaggacggtaaaacgtatggtgctttccttttggataaccagcatacatatccgtcgtctcctaaccccagcaattaa

SEQ ID NO: 1080 - protein, 282 aa, X. nematophila
MNTKSKIYLALALVLSVTACSRGGGSHHGVSGETGKQPGYKERPLLPSDYPSQSKQNTVSGLKGYSNGSFSNYVYTTLTNSPEAGANPAPLSKYYYLHIPGEGDNYVPIQVSNFTVGGDYDMSFMAQNKKAVIGSSNKRIYLATDLNNLRPYTGSVNKATFSGLARHSENGKLSILKVVMDATFGGTGENGEMFAQMKGSLQKNGKDWAPFEGYTPIMNGMSTMKFTGDAPEGLRKGDLTGYFSDPEAGAFTGTYNSKDGKTYGAFLLDNQHTYPSSPNPSN

SEQ ID NO: 1081 - DNA, 741 bp, X. nematophilia
atgaaaaagttcaacgtattagttgccgctttaggggcattgggatttatggcacaggctcaggcagcagtaggatttggtcagagccaagatgaaacaacgccacacattaaggttggtgcaacccaaccgggttcaggcccacacggtggcaaaggtggcgaacccggcattggtgtcagttccgtttatggtggtcagatcactggctttgccggcttgactcgcatggcacctgctgacagcaatggtatccataacatctcaatggcaggagcacccggctctcacggtggtatgggcgtattccatttcagcaaagttgccaatgcagatgtttacttcggtgaatggtctcagacaggtcaggcatcggatagcacccacacggtttattatgcaggcaaggacgtcactaccaatatcccaacagacggtacagcgacttacaccgtgacgggtattaaccaatacagtggcgacaatgccctgtccggcacatttaccgcagattttggtgaaaaaacgctggctggttcactggcaaatactgcgatgacgatagacattgatgccagtatcggcgctgatgccaaatttgaaggtgctgccataacggatactttggttgggcaaaccaacggccacttctttggtgacagtgctgccagcttggctggatatgccacatttgctgatgacagtaccaaggataccgcattcggtggttctaaacagtaa

SEQ ID NO: 1082 - protein, 246 aa, X. nematophilia
MKKFNVLVAALGALGFMAQAQAAVGFGQSQDETTPHIKVGATQPGSGPHGGKGGEPGIGVSSVYGGQITGFAGLTRMAPADSNGIHNISMAGAPGSHGGMGVFHFSKVANADVYFGEWSQTGQASDSTHTVYYAGKDVTTNIPTDGTATYTVTGINQYSGDNALSGTFTADFGEKTLAGSLANTAMTIDIDASIGADAKFEGAAITDTLVGQTNGHFFGDSAASLAGYATFADDSTKDTAFGGSKQ

SEQ ID NO: 1083 - DNA, 1017 bp, P. multocida PM1514
atgcagtattttgacatcaaaaaatctctccctgttttttgttctcttctgattaccgcttgtagtggtggtgggggtaataacaatccatctcactctcctatggaaaaacgtaccgtaactataccacaagcacaaaaagtagcagaaaaaccagcgctaacaatacaaacagtggtaacttcaccaactacaccaattaaagcgccctcactcgctccgactattgatactgcgcctaaacaaaatcccgtgccgacagcgcaaataacggctactttaccagccgaacctgttaaagtgccagttctgattcccgaagtaaacaaaacacttttagaaacatcaactaatccagtaaaagattcttataataaagatgctgtatttacatacgaattaatcgcaaatccagatgcagattatagcgatcaaaaattgattcttaaaaaagaaattagttatatcaaacttaatctaggcataaatcaagacaataaaaatgcaccaagctatatttttaatttactagatgacaatgtctattatggtttttatcgtgatactcaagatatgaacagaatagaaaataaatatacttatgctttcaaaaaagaagctgaaaattttgataaccttcaaaaatttaatgcgacttatgaaggtcaattttggttctctagtatagatactccaaatgtacctactgttgcaagagcattcttaacatataacaatggtagagtggatggtgaaatattggctaaacattggaatgaaaaattgtttcagattactggatttgataataatcctcgtaaagtagaaatttttcctactgtagaatatttacctaattcgggaacaagactaacaaaaggagccacatcacctcatcgtttccaaatggacttacatttcatcaatagtacaaatggtgaaaaaaacaaatatcttgtcggccaaggtagtactgagcagtactggggtgttttaggtatggagaaaaaacaataa

SEQ ID NO: 1084 - protein, 338 aa, P. multocida
MQYFDIKKSLPVFCSLLITACSGGGGNNNPSHSPMEKRTVTIPQAQKVAEKPALTIQTVVTSPTTPIKAPSLAPTIDTAPKQNPVPTAQITATLPAEPVKVPVLIPEVNKTLLETSTNPVKDSYNKDAVFTYELIANPDADYSDQKLILKKEISYIKLNLGINQDNKNAPSYIFNLLDDNVYYGFYRDTQDMNRIENKYTYAFKKEAENFDNLQKFNATYEGQFWFSSIDTPNVPTVARAFLTYNNGRVDGEILAKHWNEKLFQITGFDNNPRKVEIFPTVEYLPNSGTRLTKGATSPHRFQMDLHFINSTNGEKNKYLVGQGSTEQYWGVLGMEKKQ

SEQ ID NO: 1085 - DNA, 1041 bp, P. multocida PM1514-Flag
atgcagtattttgacatcaaaaaatctctccctgttttttgttctcttctgattaccgcttgtagtggtggtgggggtaataacaatccatctcactctcctatggaaaaacgtaccgtaactataccacaagcacaaaaagtagcagaaaaaccagcgctaacaatacaaacagtggtaacttcaccaactacaccaattaaagcgccctcactcgctccgactattgatactgcgcctaaacaaaatcccgtgccgacagcgcaaataacggctactttaccagccgaacctgttaaagtgccagttctgattcccgaagtaaacaaaacacttttagaaacatcaactaatccagtaaaagattcttataataaagatgctgtatttacatacgaattaatcgcaaatccagatgcagattatagcgatcaaaaattgattcttaaaaaagaaattagttatatcaaacttaatctaggcataaatcaagacaataaaaatgcaccaagctatatttttaatttactagatgacaatgtctattatggtttttatcgtgatactcaagatatgaacagaatagaaaataaatatacttatgctttcaaaaaagaagctgaaaattttgataaccttcaaaaatttaatgcgacttatgaaggtcaattttggttctctagtatagatactccaaatgtacctactgttgcaagagcattcttaacatataacaatggtagagtggatggtgaaatattggctaaacattggaatgaaaaattgtttcagattactggatttgataataatcctcgtaaagtagaaatttttcctactgtagaatatttacctaattcgggaacaagactaacaaaaggagccacatcacctcatcgtttccaaatggacttacatttcatcaatagtacaaatggtgaaaaaaacaaatatcttgtcggccaaggtagtactgagcagtactggggtgttttaggtatggagaaaaaacaagactacaaggatgacgatgacaagtaa

SEQ ID NO: 1086 - protein, 346 aa, P. multocida PM1514-Flag
MQYFDIKKSLPVFCSLLITACSGGGGNNNPSHSPMEKRTVTIPQAQKVAEKPALTIQTVVTSPTTPIKAPSLAPTIDTAPKQNPVPTAQITATLPAEPVKVPVLIPEVNKTLLETSTNPVKDSYNKDAVFTYELIANPDADYSDQKLILKKEISYIKLNLGINQDNKNAPSYIFNLLDDNVYYGFYRDTQDMNRIENKYTYAFKKEAENFDNLQKFNATYEGQFWFSSIDTPNVPTVARAFLTYNNGRVDGEILAKHWNEKLFQITGFDNNPRKVEIFPTVEYLPNSGTRLTKGATSPHRFQMDLHFINSTNGEKNKYLVGQGSTEQYWGVLGMEKKQDYKDDDDK

SEQ ID NO: 1087 - DNA, 1524 bp, P. multocida PM1515 (N-terminal His)
atgaaatacctgctgccgaccgctgctgctggtctgctgctcctcgctgcccagccggcgatggccatggcccatcatcaccatcaccacaatactgtgatccccgtagataatagccgaccagatgaaacattttcccagacgtcacctaaacagcatctcttttctcagaaaccgaaaccgactgaacccacatcaagtgcgagcagtcagcaaatttcgttgaccattgaacaacttgctagcagacctgatttggtgcttcgcgccttaatcccggcattaaaaaataatgatatgcgcggtgcggaaattctgttacccatttatgcccaacaatcgcctgatccgctgttattaaaatgggcacaggcaatggttgctcgtaaacaaggaaaattaagtgaatcagtacgtttatatcgccaaattattgcagaaaagcccaatttacaacctgcacgcttacaactcgctatcgccttaacgcaaaaccgtgaaaatgaagccgcgaaagcacaatttaaccaactgcgttcagaaaacttacccgcgcctttactgaccctcattgatagctatattgatgcgattaaccaacgcgatagctggaatgtgtatggcggagtaaattatttgcatgagaacaatgtcaataatgcaccgcctaaaggcaccaaagcggaaggcttcaccccttcaagccaaccagaaaaagcacatggtttaagttattttattaatttaagtaaaaattggtcattagcccacggctttttcacagaatttagtgccgatatcaatggaaaatattattgggataatcataagtatgatgagttttcgactcgcctcaatctaggtggtggttaccgtaatgccaaaacagaagtgaaacttatacctttcgtggaacaattttggtatgtgggcggtgaaaatgcaacaaaggatgcacgtacattacaccgttattctaaaagctcaggtatcaaccttgacgtggattattggttgacacccaattggaaaatctccacggttctggaatataccgaacaacgttatatccaacctcaacggcaaagctcaaatggaaatagctattccattagcaatactctgatatatatgccaaatagccaacaattttggtttgttggattcgattattatcaaaaaatacccggcttaaaagcctatgcttttgaacgtcaaggaatacgtctaggttgggggcaagaatggccgaaaggcatttcaacgcgtttacaaacaagctatgccacgcgtacttatcgagcaccttcagcagaaaagaatatgattttcgcgccgagtttctttaaagttgtgcaaaaaaatcgcgaatacggtgtcaattttacgatttggcatcgtagtcttcactggttggggatcacgcctaaaatcacttgggcatatcaaaaaaccaccagtaacaatcctttttccgaatatgaccggaatcggatttatttaaccttcagtaaaacattttaa

SEQ ID NO: 1088 - protein, 507 aa, P. multocida PM1515 (N-terminal His)
MKYLLPTAAAGLLLLAAQPAMAMAHHHHHHNTVIPVDNSRPDETFSQTSPKQHLFSQKPKPTEPTSSASSQQISLTIEQLASRPDLVLRALIPALKNNDMRGAEILLPIYAQQSPDPLLLKWAQAMVARKQGKLSESVRLYRQIIAEKPNLQPARLQLAIALTQNRENEAAKAQFNQLRSENLPAPLLTLIDSYIDAINQRDSWNVYGGVNYLHENNVNNAPPKGTKAEGFTPSSQPEKAHGLSYFINLSKNWSLAHGFFTEFSADINGKYYWDNHKYDEFSTRLNLGGGYRNAKTEVKLIPFVEQFWYVGGENATKDARTLHRYSKSSGINLDVDYWLTPNWKISTVLEYTEQRYIQPQRQSSNGNSYSISNTLIYMPNSQQFWFVGFDYYQKIPGLKAYAFERQGIRLGWGQEWPKGISTRLQTSYATRTYRAPSAEKNMIFAPSFFKVVQKNREYGVNFTIWHRSLHWLGITPKITWAYQKTTSNNPFSEYDRNRIYLTFSKTF

SEQ ID NO: 1089 - DNA, 2571 bp, P. multocida PM1515-PM1514-Flag
atgaaatacctgctgccgaccgctgctgctggtctgctgctcctcgctgcccagccggcgatggccatggcaaatactgtgatccccgtagataatagccgaccagatgaaacattttcccagacgtcacctaaacagcatctcttttctcagaaaccgaaaccgactgaacccacatcaagtgcgagcagtcagcaaatttcgttgaccattgaacaacttgctagcagacctgatttggtgcttcgcgccttaatcccggcattaaaaaataatgatatgcgcggtgcggaaattctgttacccatttatgcccaacaatcgcctgatccgctgttattaaaatgggcacaggcaatggttgctcgtaaacaaggaaaattaagtgaatcagtacgtttatatcgccaaattattgcagaaaagcccaatttacaacctgcacgcttacaactcgctatcgccttaacgcaaaaccgtgaaaatgaagccgcgaaagcacaatttaaccaactgcgttcagaaaacttacccgcgcctttactgaccctcattgatagctatattgatgcgattaaccaacgcgatagctggaatgtgtatggcggagtaaattatttgcatgagaacaatgtcaataatgcaccgcctaaaggcaccaaagcggaaggcttcaccccttcaagccaaccagaaaaagcacatggtttaagttattttattaatttaagtaaaaattggtcattagcccacggctttttcacagaatttagtgccgatatcaatggaaaatattattgggataatcataagtatgatgagttttcgactcgcctcaatctaggtggtggttaccgtaatgccaaaacagaagtgaaacttatacctttcgtggaacaattttggtatgtgggcggtgaaaatgcaacaaaggatgcacgtacattacaccgttattctaaaagctcaggtatcaaccttgacgtggattattggttgacacccaattggaaaatctccacggttctggaatataccgaacaacgttatatccaacctcaacggcaaagcaaaaatggaaatagctattccattagcaatactctgatatatatgccaaatagccaacaattttggtttgttggattcgattattatcaaaaaaatacccggctaaaagcctatgcttttgaacgtcaaggaatacgtctaggttgggggcaagaatggccgaaaggcatttcaacgcgtttacaaacaagctatgccacgcgtacttatcgagcaccttcagcagaaaagaatatgattttcgcgccgagtttctttaaagttgtgcaaaaaaatcgcgaatacggtgtcaattttacgatttggcatcgtagtcttcactggttggggatcacgcctaaaatcacttgggcatatcaaaaaaccaccagtaacaatcctttttccgaatatgaccggaatcggatttatttaaccttcagtaaaacattttaaccattttatttaaaaggaattgtcatgcagtattttgacatcaaaaaatctctccctgttttttgttctcttctgattaccgcttgtagtggtggtgggggtaataacaatccatctcactctcctatggaaaaacgtaccgtaactataccacaagcacaaaaagtagcagaaaaaccagcgctaacaatacaaacagtggtaacttcaccaactacaccaattaaagcgccctcactcgctccgactattgatactgcgcctaaacaaaatcccgtgccgacagcgcaaataacggctactttaccagccgaacctgttaaagtgccagttctgattcccgaagtaaacaaaacacttttagaaacatcaactaatccagtaaaagattcttataataaagatgctgtatttacatacgaattaatcgcaaatccagatgcagattatagcgatcaaaaattgattcttaaaaaagaaattagttatatcaaacttaatctaggcataaatcaagacaataaaaatgcaccaagctatatttttaatttactagatgacaatgtctattatggtttttatcgtgatactcaagatatgaacagaatagaaaataaatatacttatgctttcaaaaaagaagctgaaaattttgataaccttcaaaaatttaatgcgacttatgaaggtcaattttggttctctagtatagatactccaaatgtacctactgttgcaagagcattcttaacatataacaatggtagagtggatggtgaaatattggctaaacattggaatgaaaaattgtttcagattactggatttgataataatcctcgtaaagtagaaatttttcctactgtagaatatttacctaattcgggaacaagactaacaaaaggagccacatcacctcatcgtttccaaatggacttacatttcatcaatagtacaaatggtgaaaaaaacaaatatcttgtcggccaaggtagtactgagcagtactggggtgttttaggtatggagaaaaaacaagactacaaggatgacgatgacaagtaa

SEQ ID NO: 1090 - protein, 855 aa, P. multocida PM1515-PM1514-Flag
MKYLLPTAAAGLLLLAAQPAMAMANTVIPVDNSRPDETFSQTSPKQHLFSQKPKPTEPTSSASSQQISLTIEQLASRPDLVLRALIPALKNNDMRGAEILLPIYAQQSPDPLLLKWAQAMVARKQGKLSESVRLYRQIIAEKPNLQPARLQLAIALTQNRENEAAKAQFNQLRSENLPAPLLTLIDSYIDAINQRDSWNVYGGVNYLHENNVNNAPPKGTKAEGFTPSSQPEKAHGLSYFINLSKNWSLAHGFFTEFSADINGKYYWDNHKYDEFSTRLNLGGGYRNAKTEVKLIPFVEQFWYVGGENATKDARTLHRYSKSSGINLDVDYWLTPNWKISTVLEYTEQRYIQPQRQSKNGNSYSISNTLIYMPNSQQFWFVGFDYYQKNTRLKAYAFERQGIRLGWGQEWPKGISTRLQTSYATRTYRAPSAEKNMIFAPSFFKVVQKNREYGVNFTIWHRSLHWLGITPKITWAYQKTTSNNPFSEYDRNRIYLTFSKTFPFYLKGIVMQYFDIKKSLPVFCSLLITACSGGGGNNNPSHSPMEKRTVTIPQAQKVAEKPALTIQTVVTSPTTPIKAPSLAPTIDTAPKQNPVPTAQITATLPAEPVKVPVLIPEVNKTLLETSTNPVKDSYNKDAVFTYELIANPDADYSDQKLILKKEISYIKLNLGINQDNKNAPSYIFNLLDDNVYYGFYRDTQDMNRIENKYTYAFKKEAENFDNLQKFNATYEGQFWFSSIDTPNVPTVARAFLTYNNGRVDGEILAKHWNEKLFQITGFDNNPRKVEIFPTVEYLPNSGTRLTKGATSPHRFQMDLHFINSTNGEKNKYLVGQGSTEQYWGVLGMEKKQDYKDDDDK

SEQ ID NO: 1091 - DNA, 24 bp, Artificial Sequence
  Flag sequence
gactacaaggatgacgatgacaag

SEQ ID NO: 1092 - protein, 8 aa, Artificial Sequence
  Flag sequene
DYKDDDDK

SEQ ID NO: 1093 - DNA, 1800 bp, N. meningitidis TbpB
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtgcgaagcagaaagataagaaggatggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcatcggtggtattcggtgcgaaacgccaacagcttgtgcaataa

SEQ ID NO: 1094 - protein, 599 aa, N. meningitidis TbpB
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 1095 - DNA, 1053 bp, N. meningitidis TbpB N lobe
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtgcgaagcagaaagataagaaggat

SEQ ID NO: 1096 - protein, 351 aa, N. meningitidis TbpB N lobe
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKD

SEQ ID NO: 1097 - DNA, 927 bp, N. meningitidis TbpB C lobe
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaaggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcatcggtggtattcggtgcgaaacgccaacagcttgtgcaataa

SEQ ID NO: 1098 - protein, 308 aa, N. meningitidis TbpB C lobe
MNNPLVNQAAMVLPVFLLSACLGGGGSFDLDSVETVQDMHSKPKYEDEKSQPESQQDVSEGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 1099 - DNA, 1026 bp, N. meningitidis HpuA; identical to SEQ ID NO: 931

SEQ ID NO: 1100 - protein, 341 aa, N. meningitidis HpuA; identical to SEQ ID NO: 932

SEQ ID NO: 1101 - DNA, 2025 bp, N. meningitidis TbpB N lobe-HpuA fusion
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtgcgaagcagaaagataagaaggatgccgggggaggggtagccgaaccgcacgtccccgtgtccatccccaccgccaccccgctgcccaccggcgaggtaaagttatcagacgacaatagcaaaatcgaaaacatcaacaccgccgacaccggaagcacatccggcatttccattcagcagcggaaatatgaagtagaaagttacggcatcaaaagagaagaaaaagcattcatcttccaaacacccggcggcgcgcaatacgccctttcatcctacgccgaccccataaccgtcagctactcctcccccgatttcaaaattcccgaccgccacgcagggcagcggcttgccgacggcagccgcatctttatctgttgcagcgaatccggggctacttcgtatgcggaaatcaccaaacaagattatatgaaattcggggcgtggataggtcccaacggcgaaatcgacctcttcgccggcggcttccccgtcggcaaaacgccgaagcctaaatactcttggggcaacaccgaacccgaaaccaaaggcaagggcaaaatcacttatcaggtttggggcatccgcgtcagaaacaggcaatttgttacttcctcttatacgccgccgaaaagcggttcttattatgggacacttgccaacacccccgtcctttcctttatcactgccaatttcaacagcaacaaactggcaggcgaaatccgcggcaacagcgattacggaccgagtgtgaaaattgaaaacgcaacgattaacagtttatccttttccggcactgccacgtccggcgggaaaaccggcaatttggaaggcaagttttttggaaaattcaacggctaccgggacactgaaaccagcataggcggcaaaatcacctttgacggcgaccgctccctcgataccgtattcggcggtgtgagttataaaaaagaacttgaaaacaacactgatacaagtaccacccatctcacaaaataa

SEQ ID NO: 1102 - protein, 674 aa, N. meningitidis TbpB N lobe-HpuA fusion
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDAGGGVAEPHVPVSIPTATPLPTGEVKLSDDNSKIENINTADTGSTSGISIQQRKYEVESYGIKREEKAFIFQTPGGAQYALSSYADPITVSYSSPDFKIPDRHAGQRLADGSRIFICCSESGATSYAEITKQDYMKFGAWIGPNGEIDLFAGGFPVGKTPKPKYSWGNTEPETKGKGKITYQVWGIRVRNRQFVTSSYTPPKSGSYYGTLANTPVLSFITANFNSNKLAGEIRGNSDYGPSVKIENATINSLSFSGTATSGGKTGNLEGKFFGKFNGYRDTETSIGGKITFDGDRSLDTVFGGVSYKKELENNTDTSTTHLTK

SEQ ID NO: 1103 - DNA, 1800 bp, N. meningitidis TbpB polyalanine mutant B22
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtgcgaagcagaaagataagaaggatggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatggctgcagcagctgcagctgcagcaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcatcggtggtattcggtgcgaaacgccaacagcttgtgcaataa

SEQ ID NO: 1104 - protein, 599 aa, N. meningitidis TbpB polyalanine mutant B22
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDGENAAGPATETVIDAYRITGEEFKKEQIDSFGDVKKLLVDGVELSLLPSEGNKAAFQHEIEQNGVKATVCCSNLDYMAAAAAAAANKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 1105 - DNA, 1800 bp, N. meningitidis TbpB polyalanine mutant B23
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtgcgaagcagaaagataagaaggatggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgctgcagcagctgcagctgcacgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcatcggtggtattcggtgcgaaacgccaacagcttgtgcaataa

SEQ ID NO: 1106 - protein, 599 aa, N. meningitidis TbpB polyalanine mutant B23
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDGENAAGPATETVIDAYRITGEEFKKEQIDSFGDVKKLLVDGVELSLLPSEGNKAAFQHEIEQNGVKATVCCSNLDYMSFGKLSKENKDAAAAAAARTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKASVVFGAKRQQLVQ

SEQ ID NO: 1107 - DNA, 1800 bp, N. meningitidis TbpB polyalanine mutant B30
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtgcgaagcagaaagataagaaggatggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgaggcagcagctgcagctgcatttccgggaaatgcaccagagggaaaacaagaaaaagcatcggtggtattcggtgcgaaacgccaacagcttgtgcaataa

SEQ ID NO: 1108 - protein, 599 aa, N. meningitidis TbpB polyalanine mutant B30
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEAAAAAAFPGNAPEGKQEKASVVFGAKRQQLVQ

SEQ ID NO: 1109 - DNA, 1800 bp, N. meningitidis TbpB polyalanine mutant B31
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacgggccgaaaggcgaggaacttgccggtaaattcttgagcaacgacaacaaagttgcagcggtgtttggtgcgaagcagaaagataagaaggatggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggtggtaatagggcagagtttgacgtggatttttccactaaaaaaatcagtggcacactgacggcaaaagaccgtacgtctcctgcgtttactattactgccatgattaaggacaacggtttttcaggtgtggcgaaaaccggtgaaaacggctttgcgctggatccgcaaaataccggaaattcccactatacgcatattgaagccactgtatccggcggtttctacggcaaaaacgccatcgagatgggcggatcgttctcatttccgggaaatgcaccagagggaaaacaagaaaaagcagctgcagcagctgcagctgcacgccaacagcttgtgcaataa

SEQ ID NO: 1110 - protein, 599 aa, N. meningitidis TbpB polyalanine mutant B31
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKDGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITAMIKDNGFSGVAKTGENGFALDPQNTGNSHYTHIEATVSGGFYGKNAIEMGGSFSFPGNAPEGKQEKAAAAAAAARQQLVQ

SEQ ID NO: 1111 - DNA, 857 bp, N. meningitidis
ggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggctggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 1112 - protein, 284 aa, N. meningitidis
KVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 1113 - DNA, 1566 bp, K. denitrificans
atgaaatacctgctgccgaccgctgctgctggtctgctgctcctcgctgcccagccggcgatggccatggcccatcatcaccatcaccacgaaccgctgccgcagaccgcagcagaacaggcaggcgaaagcctgcagcagcagccgtggctgcagagcctggaagcagatggtgccggtgaaaaacagcctgcactggaacgtaaaggtgcagcaccggttgttgttcgtaatcaggatctgcgtgaacatccggaactgctggcagcaatgctgcgtcaggcagttgatgcacgtcatgaacctctgctgggtgcactgctgccgacctatctgaccctgccgcaagaacagcaggatgcaaaactgcgtcagcatgcacaggcagaactggcacgtctgcgtggtgattatccgaccgcaaccgcacattatcaggccgttcagcgtcagtatccggatgatgttcgtctgcagctggatagcgcagcaaccctggccgaagatcgtcagtggcgtgaagcagaagcactgtttgcccaggcagcacagacccctgaactgccggataccgttgcagaaaatattcgtctgtatcgtaatggcattcgtcagaatacccagtggcaggttcagggtggtgttcagctgagctatgataaaaacattaatgatgcaccgcaggcctattgtacaccgctgggttgtgttcgtgaacgtcaagaaaatgcatggggtctgcgttatcgtgtttatgcagaaaaaaacaccccgattcgtggtcatcataatctgctgtttcgtatgaatgcaagcggcaccacctattatctgagccagcgtagcgcatatgattatgccctggcacgtgcaagcctgggttatcgttttcaggatgcccgtcagagtctggaaattctgccgttttatcaggcacagtttagcggtagccgtcagtttcctgataaagcaccgcgtcagaaacgtgttctgccgtatatgctgggtcatgcagtgggtgttcaggcagcatttgaacgtcagctggcaccgaaatggaccggttttgttagtctggaaggtatgcgtcaggattttcgtgaagccgaacgtgcccgtcatcagaatggtatggtttggaatgcatttgccagcctgagctatcgtattcgtcctcaacatctgctgttcgcaggttatggttggggtagcctgcatccagataatgatatggttggtggtcgtgcaaatagcagcggttatgttcgtcatagcgtgcaggcaggttggctggcacagtggaccgcactgggcaatctgaataccgaagtgcgtggccagtatacccagcgtcgttatcgcggtagcgcactggataccgcatttctgcgtcgtccgcagcgtaataatgaacgtagcctgaccgttgcactgagttatccgaaatggcgtgtttggggtgcagttccgaaactggtttggcaagaaaatcgtattgatagcacccatgattgggcagatcgtcgtcagcgtaatgtttggctggaatgggaaaaacgcttttaa

SEQ ID NO: 1114 - protein, 521 aa, K. denitrificans
MKYLLPTAAAGLLLLAAQPAMAMAHHHHHHEPLPQTAAEQAGESLQQQPWLQSLEADGAGEKQPALERKGAAPVVVRNQDLREHPELLAAMLRQAVDARHEPLLGALLPTYLTLPQEQQDAKLRQHAQAELARLRGDYPTATAHYQAVQRQYPDDVRLQLDSAATLAEDRQWREAEALFAQAAQTPELPDTVAENIRLYRNGIRQNTQWQVQGGVQLSYDKNINDAPQAYCTPLGCVRERQENAWGLRYRVYAEKNTPIRGHHNLLFRMNASGTTYYLSQRSAYDYALARASLGYRFQDARQSLEILPFYQAQFSGSRQFPDKAPRQKRVLPYMLGHAVGVQAAFERQLAPKWTGFVSLEGMRQDFREAERARHQNGMVWNAFASLSYRIRPQHLLFAGYGWGSLHPDNDMVGGRANSSGYVRHSVQAGWLAQWTALGNLNTEVRGQYTQRRYRGSALDTAFLRRPQRNNERSLTVALSYPKWRVWGAVPKLVWQENRIDSTHDWADRRQRNVWLEWEKRF

SEQ ID NO: 1115 - DNA, 849 bp, N. meningitidis FHbp
gtgaaccgaactaccttctgctgcctttctctgaccgccgccctgattctgaccgcctgcagcagcggaggcggcggaagcggaggcggcggtgtcgccgccgacatcggcgcggggcttgccgatgcactaaccgcaccgctcgaccataaagacaaaggtttgaaatccctgacattggaagactccatttcccaaaacggaacactgaccctgtcggcacaaggtgcggaaagaactttcaaagccggcgacaaagacaacagtctcaacacaggcaaactgaagaacgacaaaatcagccgcttcgactttatccgtcaaatcgaagtggacgggcagctcattaccttggagagcggagagttccaagtgtacaaacaaagccattccgccttaaccgcccttcagaccgagcaagtacaagactcggagcattccgggaagatggttgcgaaacgccagttcagaatcggcgacatagtgggcgaacatacatcttttggcaagcttcccaaagacgtcatggcgacatatcgcgggacggcgttcggttcagacgatgccggcggaaaactgacctacaccatagatttcgccgccaagcagggacacggcaaaatcgaacatttgaaatcgccagaactcaatgttgacctggccgccgccgatatcaagccggatgaaaaacaccatgccgtcatcagcggttccgtcctttacaaccaagccgagaaaggcagttactctctaggcatctttggcgggcaagcccaggaagttgccggcagcgcggaagtggaaaccgcaaacggcatacgccatatcggtcttgccgccaagcaataa

SEQ ID NO: 1116 - protein, 282 aa, N. meningitidis FHbp
VNRTTFCCLSLTAALILTACSSGGGGSGGGGVAADIGAGLADALTAPLDHKDKGLKSLTLEDSISQNGTLTLSAQGAERTFKAGDKDNSLNTGKLKNDKISRFDFIRQIEVDGQLITLESGEFQVYKQSHSALTALQTEQVQDSEHSGKMVAKRQFRIGDIVGEHTSFGKLPKDVMATYRGTAFGSDDAGGKLTYTIDFAAKQGHGKIEHLKSPELNVDLAAADIKPDEKHHAVISGSVLYNQAEKGSYSLGIFGGQAQEVAGSAEVETANGIRHIGLAAKQ

SEQ ID NO: 1117 - DNA, 798 bp, N. lactamica FHbp
atgagaaccctccgcatttctgctttgactgcttccctgtctttgatgttggctgcctgcggtggcgcaacaagcggcttgtcgaatgccctgaccaaaccgctcaatccgcatccgaaaggcgtgttgtccattgaattgaacgaatctgtccctgaaaacggtacgttggagctgacggccaacggtaaaacgcaaaccctacaaaaaggcagcaaactcgataccggctttttgaaaactgataaagtatcctcttacgactacgcccaaaaaattaaggtaaacggccaagtcatcactttggaaacgggcgacttccaagtgtataaacaaaattattccgctgttgccgcgcgttacgccaaacaaaaagccgatgacgcgggcaagctgcaaaacctcgatacatacacattcaccgtcggcgaagtccaaggcgatgaaaccgcttatcgcaatttgcccaaacaaggcagctatcagtattcgggtattgcgtttaacggcgatgaccgcagcggccgcctgaaatacaccgtcgatttcgataaaaaacaaggttacggcaaaatcagcagcatggcttcccacaataatgtcgacctgcttgcagcaggcattgccaataacaatggtaaagccgccatcagcggtaaaaccagtttaaacggtatcgaaaacggtcgttatgatttaaaactcttcggcccgcaggctcaagaaattgccggtaaggcgcaaatcaaagttggcgattccaccaaagaaatcggtttggccggtaagaaagagtag

SEQ ID NO: 1118 - protein, 265 aa, N. lactamica FHbp
MRTLRISALTASLSLMLAACGGATSGLSNALTKPLNPHPKGVLSIELNESVPENGTLELTANGKTQTLQKGSKLDTGFLKTDKVSSYDYAQKIKVNGQVITLETGDFQVYKQNYSAVAARYAKQKADDAGKLQNLDTYTFTVGEVQGDETAYRNLPKQGSYQYSGIAFNGDDRSGRLKYTVDFDKKQGYGKISSMASHNNVDLLAAGIANNNGKAAISGKTSLNGIENGRYDLKLFGPQAQEIAGKAQIKVGDSTKEIGLAGKKE

SEQ ID NO: 1119 - DNA, 825 bp, N. cinerea FHbp
gtgaaccgaactaccttctgttgcctttctttgaccgccgccctgattctgaccgcctgcagcagcggaggaggcggtgtcgccgccgacatcggtgcggggcttgccgatgcactaaccgcaccgctcgaccataaagacaaaggtttgcagtctttgacgctggatcagtccgtcaggaaaaacgagaaactgaagctggcggcacaaggtgcggaaaaaacttatggaaacggcgacagcctcaatacgggcaaattgaagaacgacaaggtcagccgtttcgactttatccgccaaatcgaagtggacgggcagctcattaccttggagagtggagagttccaagtgtacaaacaaagccattccgccttaaccgcccttcagacagagcaagtacaagattcggagcattcagggaagatggttgcgaaacgccagttcagaatcggcgatatagcgggcgaacatacatcttttgacaagcttcccgaaggcgtcagggcgacatatcgcgggacggcattcggttcagacgatgccggtggaaaactgacctacaccatagatttcgccgccaagcagggacacggcaaaatcgaacatttgaaatcgccagaactcaatgtcgacctggccgccgccgatatcaagccggatgaaaaacaccatgccgtcatcagcggttccgtcctttacaaccaagacgagaaaggcagttactccctcggtatctttggcggaaaagcccaggaagttgccggcagcgcggaagtgaaaaccgtaaacggcatacgccatatcggccttgccgccaagcaataa

SEQ ID NO: 1120 - protein, 274 aa, N. cinerea FHbp
VNRTTFCCLSLTAALILTACSSGGGGVAADIGAGLADALTAPLDHKDKGLQSLTLDQSVRKNEKLKLAAQGAEKTYGNGDSLNTGKLKNDKVSRFDFIRQIEVDGQLITLESGEFQVYKQSHSALTALQTEQVQDSEHSGKMVAKRQFRIGDIAGEHTSFDKLPEGVRATYRGTAFGSDDAGGKLTYTIDFAAKQGHGKIEHLKSPELNVDLAAADIKPDEKHHAVISGSVLYNQDEKGSYSLGIFGGKAQEVAGSAEVKTVNGIRHIGLAAKQ

SEQ ID NO: 1121 - DNA, 798 bp, N. flavescens FHbp
atgagaactttccatgtttctgctttgactgcttccctgtctttgatgttggctgcctgcggtggcgcaacaagcggcttgtcgaatgccgtgaccgaaccgctcaatccgcatccgaaaggcgtgttgtccattgaattgaacgaatccgtccctgaaaacggtacgttggagctgacggccaacggtaaaacgcaaaccctgaaaaaaggcggcaaactcgataccggctttttgaaaaccgataaagtatcctcttacgactacgcccaaaaaattaaggtaaaaggccaagtcatcactttggaaacgggcgacttccaagtgtataaacaaaattattccactgttgccgcgcgttacgccaaacaaaaagccgatgacgcaggcaagctgcaaaacctcgatacatacacattcaccgtcggcgaagtccaaggcgatgaaaccgcttaccgcaatttgcccaaacaaggcagctatcagtattcgggcattgcgtttaacggcgatgaccgcagcggccgtctgaaatacaccgtcgatttcgataaaaaacaaggttacggcaaaatcagcagcatggcttcccacaataatgtcgacctgcttgcagcaggcattgccaataacaatggtaaagccgccatcagcggtaaaaccagtttgaacggcgtggaaaacggccgttatgatttgaaactcttcggtccgcaggctgaagaaattgccggtaaggcgcaaatcaaagttggtgactctaccaaagaaattggtttggccggtaagaaagaatag

SEQ ID NO: 1122 - protein, 265 aa, N. flavescens FHbp
MRTFHVSALTASLSLMLAACGGATSGLSNAVTEPLNPHPKGVLSIELNESVPENGTLELTANGKTQTLKKGGKLDTGFLKTDKVSSYDYAQKIKVKGQVITLETGDFQVYKQNYSTVAARYAKQKADDAGKLQNLDTYTFTVGEVQGDETAYRNLPKQGSYQYSGIAFNGDDRSGRLKYTVDFDKKQGYGKISSMASHNNVDLLAAGIANNNGKAAISGKTSLNGVENGRYDLKLFGPQAEEIAGKAQIKVGDSTKEIGLAGKKE

SEQ ID NO: 1123 - DNA, 798 bp, N. mucosa FHbp
atgagaaccctccgcatttctgctttgacggcttccctgtctttgatgttggctgcctgcggcggcgcaacaagcggcttgtcaaatgccgttaccgagccgctcaatccgcatccgaaaggcgtgttgtccgttgaattgaacgaatccgtccctgaaaacggtacgttggacctgacagccaacggtaaaacgcaaaccctgcaaaaaggtgacaaactcgataccggctttttgaaaaccgataaagtatcctcttacgactacgcccaaaaaatcaaggtaaacggccaagtcatcactttggaaacaggcgacttccaagtgtataaacaaaattattcctctgttgccgcgcgttacgccaaacaaaaagccgatgacgcaggcaagctgcaaaacctcgatacatacacatttaccgtcggcgaagtccaaggcgatgaaacagcgtatagcaatttgcccaaacaaggcagctatcagtattcgggtatcgcgtttaacggcgacgaccgcagcggccgtctgaaatacaccgtcgatttcgataaaaaacaaggttacggcaacatcagcagcatggcttcccacaataatgtcaacctgcttgccgcaggcattgccaataacaacggcaaagccgccatcagcggtaaaaccagtttgaacggtgtcgaaaacggccgttacgatttgaaactcttcggtccgcaggctgaagaaattgccggtaaggcgcaaatcaaaattggcgattccaccaaagaaatcggtttggccggtaagaaagaatag

SEQ ID NO: 1124 - protein, 265 aa, N. mucosa FHbp
MRTLRISALTASLSLMLAACGGATSGLSNAVTEPLNPHPKGVLSVELNESVPENGTLDLTANGKTQTLQKGDKLDTGFLKTDKVSSYDYAQKIKVNGQVITLETGDFQVYKQNYSSVAARYAKQKADDAGKLQNLDTYTFTVGEVQGDETAYSNLPKQGSYQYSGIAFNGDDRSGRLKYTVDFDKKQGYGNISSMASHNNVNLLAAGIANNNGKAAISGKTSLNGVENGRYDLKLFGPQAEEIAGKAQIKIGDSTKEIGLAGKKE

SEQ ID NO: 1125 - DNA, 801 bp, N. macacae FHbp
atgaaagccgtccgcttggttcttgccgcatctttggtttctacgcttgccgcctgcggcagctcctcttccgcgctgtccgatgcgataggcaaaggctttgatcctaaggctaagggcgtgaaatacattaccgttttcgagagcgttcccgaaaacggcacgatgcagctgagtgccaacaataaggtgcaaacgcttaaaaaaggcgataatttggacaccgcctttctgaagcgcgacaagatttcctattatgactacgtcggcaaaatcaacgtcaacggacaggtcatcgatttagaacgcggcgactttatggtttacaaacaagacaattcggctgtcgctgccaaatatatcaagcagaaagccgatcctgccgacggcaacaagctgaaagacttgcaggcgtatgaatttaaagtcggcgaagtgcaaggtaaggaaattgcctttaaagacctgccgcaactgggccgctatacctaccgcggtatcgcgtttaacggcgacgataatagcggccgcctgacgtacaccattgatttcgagaaaaaacaaggtcagggcaaaatcagcggcatggcacctgattacaatgtcgatttggctgccgccaacattgccgcagcaggtgcgggttcggcaatcaacggacgcgcgacgctcaataatgaagacaaaggcagctaccgtttgaacattttcggcagcaaagccgaagagattgccggtaaagcgcaagtgaaagtcggcgataaagaaaaagacatcggacttgccggtaaaaaagaataa

SEQ ID NO: 1126 - protein, 266 aa, N. macacae FHbp
MKAVRLVLAASLVSTLAACGSSSSALSDAIGKGFDPKAKGVKYITVFESVPENGTMQLSANNKVQTLKKGDNLDTAFLKRDKISYYDYVGKINVNGQVIDLERGDFMVYKQDNSAVAAKYIKQKADPADGNKLKDLQAYEFKVGEVQGKEIAFKDLPQLGRYTYRGIAFNGDDNSGRLTYTIDFEKKQGQGKISGMAPDYNVDLAAANIAAAGAGSAINGRATLNNEDKGSYRLNIFGSKAEEIAGKAQVKVGDKEKDIGLAGKKE

SEQ ID NO: 1127 - DNA, 840 bp, N. subflava FHbp
atgataaatatcataccaaataaaaaaggaaaggaaaaaatgatgagaaccctccgtattcctgctttgacggcttccctgtctttgatgttggctgcctgcggtggcgcaacaagcggcttgtcgaatgccgttaccgagccgctcaatccgcatccgaaaggcgtgttgtctgttgaattgaacgaatccgtccctgaaaacggtacgttggacctgacagccaacggtaaaacgcaaatcctgcaaaaaggtgacaaactcgataccggctttttgaaaaccgataaagtatcttcttacgactacgcccaaaaaatcaaggtaaacggccaagtcatcactttggaaacgggcgacttccaagtgtataaacaaaattattccactgttgccgcgcgttacgccaaacaaaaagccgatgacgcaggcaagctgcaaaacctcgatacatacacattcaccgtcggcgaaatccaaggcgacgaaactgcatatcgcaatttgcccaaacaaggcagctatcagtattcgggcattgcatttaacggcgacgaccgcagcggccgtctgaaatacaccattgatttcgataaaaaacaaggttacggcaacatcagcagcatggcttcctacaataatgtcgacctgcttgccgcaggcattgccaataacaacggcaaagccgccatcagcggtaaaaccagtttgaacggtatcgaaaacggccattacgatttgaaactcttcggcccgcaggctgaagaaattgccggtaaggcgcaaatcaaagttggcgattccaccaaagaaatcggtttggccggtaagaaagaatag

SEQ ID NO: 1128 - protein, 279 aa, N. subflava FHbp
MINIIPNKKGKEKMMRTLRIPALTASLSLMLAACGGATSGLSNAVTEPLNPHPKGVLSVELNESVPENGTLDLTANGKTQILQKGDKLDTGFLKTDKVSSYDYAQKIKVNGQVITLETGDFQVYKQNYSTVAARYAKQKADDAGKLQNLDTYTFTVGEIQGDETAYRNLPKQGSYQYSGIAFNGDDRSGRLKYTIDFDKKQGYGNISSMASYNNVDLLAAGIANNNGKAAISGKTSLNGIENGHYDLKLFGPQAEEIAGKAQIKVGDSTKEIGLAGKKE

SEQ ID NO: 1129 - DNA, 801 bp, N. sicca FHbp
atgaaagccgtccgcttggttcttgccgcatttttggtttctacgcttgccgcctgcggcagctcctcttccgcgctgtccgatgcgataggcaaaggctttgatcctaaggctaagggcgtgaaatacattaccgttttcgagagcgttcccgaaaacggtacgatgcagctgagtgccaacaataaggtgcaaacgcttaaaaaaggcgacaatttggacaccgcctttctgaagcgcgacaagatttcctattatgactacgtcggcaaaatcaacgtcaacggacaggtcatcgatttggaacgcggcgactttatggtttacaaacaagacaattcggctgtcgctgccaaatatatcaagcagaaagccgatcctgccgacggcaacaagctgaaagacttgcaggcgtatgaatttaaagtcggcgaagtgcaaggtaaggaaattgcctttaaagacctgccgcaactgggccgctatacctaccgcggcatcgcgtttaacggcgacgataatagcggccgtctgacgtacaccattgatttcgagaaaaaacaaggtcagggcaaaatcagcggcatggcacctgattacaatgtcgatttggctgccgccaacattgccgcagcaggggcgggttcggcaatcaacggacgcgcgacgctcaacaatgaagacaaaggtagctaccgtttgaacattttcggcagcaaggctgaagagattgccggtaaggcgcaagtgaaagtcggcgataaagagaaagacatcggacttgccggtaaaaaagaataa

SEQ ID NO: 1130 - protein, 266 aa, N. sicca FHbp
MKAVRLVLAAFLVSTLAACGSSSSALSDAIGKGFDPKAKGVKYITVFESVPENGTMQLSANNKVQTLKKGDNLDTAFLKRDKISYYDYVGKINVNGQVIDLERGDFMVYKQDNSAVAAKYIKQKADPADGNKLKDLQAYEFKVGEVQGKEIAFKDLPQLGRYTYRGIAFNGDDNSGRLTYTIDFEKKQGQGKISGMAPDYNVDLAAANIAAAGAGSAINGRATLNNEDKGSYRLNIFGSKAEEIAGKAQVKVGDKEKDIGLAGKKE

SEQ ID NO: 1131 - DNA, 801 bp, Neisseria sp. GT4A CT1 FHbp
atgaaagccgtccgcttggttcttgccgcatctttggtttctacgcttgccgcctgcggcagctcctcttccgcgctgtccgatgcgataggcaaaggctttgatcctaaggctaagggcgtgaaatacattaccgttttcgagagcgttcccgaaaacggcacgatgcagctgagtgccaacaataaggtgcaaacgcttaaaaaaggcgacaatttggacaccgcctttctgaagcgcgacaagatttcctattatgattacgtcggcaaaatcaacgtcaacggacaggtcatcgatttggaacgcggcgattttatggtttacaaacaagacaattcggctgtcgctgccaaatatatcaagcagaaagccgattctgccgacggcaacaagctgaaagacttgcaggcgtatgaatttaaagtcggcgaagtgcaaggtaaggaaattgcctttaaagacctgccgcaactgggccgctatacctaccgtggtatcgcatttaacggcgacgataatagcggccgcctgacgtacaccattgattttgagaaaaaacaaggtcagggcaaaatcagcggcatggcgcctgattacaatgtcgatttggctgccgctaacattgccgcagcaggtacgggttcggcaatcaacggacgcgcgacgctcaacaatgaagacaaaggcagctaccgtttgaacattttcggcagcaaggctgaagagattgccggtaaagcgcaagtgaaagttggcgataaagagaaagacatcggacttgccggtaaaaaagaataa

SEQ ID NO: 1132 - protein, 266 aa, Neisseria sp. GT4A CT1 FHbp
MKAVRLVLAASLVSTLAACGSSSSALSDAIGKGFDPKAKGVKYITVFESVPENGTMQLSANNKVQTLKKGDNLDTAFLKRDKISYYDYVGKINVNGQVIDLERGDFMVYKQDNSAVAAKYIKQKADSADGNKLKDLQAYEFKVGEVQGKEIAFKDLPQLGRYTYRGIAFNGDDNSGRLTYTIDFEKKQGQGKISGMAPDYNVDLAAANIAAAGTGSAINGRATLNNEDKGSYRLNIFGSKAEEIAGKAQVKVGDKEKDIGLAGKKE

SEQ ID NO: 1133 - DNA, 753 bp, M. haemolytica FHbp
atgaagagtatcaaaaaattaaccctagccactttgattttagtgggtttaactgcttgtggtagcggtggttcaggtagcagttctaataatgctaaatcgaaaccacaagttgagttaaaaaaaactgaagaggataaaaaggctgaagaagcaaaaaaaattgcagaggcaaaaggaattggcaataaagaatataaagatggattaaatgagttagaagaaaaaaatgaaacaggtaaaaacggagaagagattcgaacctatggttatctctataacagccattattccgttgtaactgccaaaatgaaacaaactttacaggaaaatggtcgtcaaatggaacctacggttgaagtgaaagggcttaaaactgagaatttaccgacagagggcaaagcaacatataaaggagaagcctttgattctcacggtaataacagcaattcagtagtaggtggagaattaatctataatgttgatttctctagtcgtaccggatcaggtctagttaaaaatgtacagggcggttctatcgagttagcacaaggcgaaataaaaaatgatagtattatagcttctgctcaccaaaagtataatgatcaggctgttggaaatggtagttacaatatccaattctttggtccaaatgcagaagaaattggagggaaaattgagcttaatggtgagggcgaaggctcaatgaagcagatgttaggtattgcaggaacccgagaagaacaaaaataa

SEQ ID NO: 1134 - protein, 250 aa, M. haemolytica FHbp
MKSIKKLTLATLILVGLTACGSGGSGSSSNNAKSKPQVELKKTEEDKKAEEAKKIAEAKGIGNKEYKDGLNELEEKNETGKNGEEIRTYGYLYNSHYSVVTAKMKQTLQENGRQMEPTVEVKGLKTENLPTEGKATYKGEAFDSHGNNSNSVVGGELIYNVDFSSRTGSGLVKNVQGGSIELAQGEIKNDSIIASAHQKYNDQAVGNGSYNIQFFGPNAEEIGGKIELNGEGEGSMKQMLGIAGTREEQK

SEQ ID NO: 1135 - DNA, 792 bp, A. actinomycetemcomitans FHbp
atgaaaacaaaatatttattggcggcgctgaccgtcgcctgcacattatccgcatgcagccaagctgccggggggttggcggatggtctactgaaaccgttcgatccgaaagcaaaagactggaagcagttaaccatctccgaatctgttcccgataacggcactttggaactaaccgaccgcggcggcaaaacccagatcttgcgtaaaggcggcgttctggatacaggccatttgagatccgataagatctctgactacgattacgtcaaaaaaatcaacgtgaacggtcaaataatcgagttggaacgaggcgattttctgatatataaacagagtaattccatcatcgccgctacgttagcgaaacagaaaaccaacgcagatggtacacgctcctctgcctttgatttccatgtcaacgagattcaagggcgagacatcgcctttaataatctgccggcttcgggacaggtaaactatcgcggcatcgcatttaccggcgatgaccgtagaggtcgtttatcctacactatcgacttcgctaaaaaacaaggcagcggtcgcatcagtgatctacgtggtgactataacgtagatttggcgcaaacagacgtccgcgcaatggggaacggttccgggttgagtggtaaggctatgaaaaatggtgtggaaagaggaaattacacgctaaaaatcttcggtaacaaggcagaagaaatcgccggtaaagctgagatcaaaaccggtaagggaactcaagaaatcggtttggcaggtaaaaaagaataa

SEQ ID NO: 1136 - protein, 263 aa, A. actinomycetemcomitans FHbp
MKTKYLLAALTVACTLSACSQAAGGLADGLLKPFDPKAKDWKQLTISESVPDNGTLELTDRGGKTQILRKGGVLDTGHLRSDKISDYDYVKKINVNGQIIELERGDFLIYKQSNSIIAATLAKQKTNADGTRSSAFDFHVNEIQGRDIAFNNLPASGQVNYRGIAFTGDDRRGRLSYTIDFAKKQGSGRISDLRGDYNVDLAQTDVRAMGNGSGLSGKAMKNGVERGNYTLKIFGNKAEEIAGKAEIKTGKGTQEIGLAGKKE

SEQ ID NO: 1137 - DNA, 2214 bp, N. meningitidis LbpB
atgtgtaaaccgaattatggcggcattgtcttgttgcccttacttttagcatcttgtatcggcggcaatttcggcgtgcagcctgttgtcgaatcaacgccgaccgcgtaccccgtcaccttcaaatctaaggacgttcccactccgccccctgccgggtcttcggtagaaaccacgccggtcaaccggcccgccgtcggtgcggcaatgcggctgccaaggcggaatattgcttcctataaacaagacggtacggaaattcccgacaagcatcaggcagaggagcatctgccgcttaaagagaaggatatcctgtttttagacggtacgctgaaagaacaggctgacaaacttaaaaagaaaatcaacgaacggtattctgatgtgagggttatcacatcgaaaaaagaagaagaaaaatatcaatatcaatttgtccgtgcgggctatgtgtttaccagggcggaaggaaaggataatgaaaaagaaaagacttctgatggtaaggagtttgttaaccgatttagttatgacggttttgtatattattccggagaacgtccttcccaatctttaccgagcgcgggaacggtgcaatattccggtaactggcaatatatgaccgatgccaaacgtcatcggacaggtaaggcggtttccagtacggatttgggttataccacatattatggtaatgaaattggggcaacttcttatgaggctagggatgccgacgacagggaaaagcatcctgccgaatatacggttgattttgataacaaaaccctgaatggcaagctgattaaaaatcagtatgtgcaaaataaaagtaatccaaatgagcccaaaaaaccgctgaccatttacgacattaccgcaacattggacggcaaccgctttaccggcagtgccaaagttagcaccgaggtgaagacgcaacacgctgataaagaatatttgtttttccataccgatgccgatcagcggcttgagggcggttttttcggcgataacggagaagagcttgccggacggtttatcagcaacgacaacagcgtattcggcgtattcgcaggcaaacaaaaaacagagacagaaaacgcagcagatacaaaacctgccctgtcgtctggaaaacacaccaaaatcttggattctctgaaaatttccgttgacgaggcaagtgataaaaatccccgtgagtttgccatttcctctatgcccgattttggtcatcccgacaaacttcttgtcgaagggcgtgaaattcctttggtaaacaaagaacaaaccatcgagcttgccgatggtaggaaaacgacaatccgaacctgctgcgattttctgacctatgtgaaaatcggacggatgcaaaccgaacgtcccgccgccaaaccgaaggcgcaggacgaagagagggacgaagaggatacaggcgttgatagcgtcgaagaaggcgaagacgaaatcgacgatgaagaaggcaccgaagacgcagccgtaaaagacgaaggcagcgaagaagacgaagccgtagaaggtgaagatgaagctgaagaacccgaagaagaatcgccgacagaagaaggcggcagcggttcagacggcatcctgcccgctccggaagcccctaaaggcaggaacatcgaccttttcctgaaaggtatccgcacggcggaaacggatattccgaaaactggagaagcacactataccggcacttgggaagcgcgtatcggcaaacccattcaatgggacaatcaggcggataaagaagcggcaaaagcagtatttaccgttgatttcggcaagaaatcgatttccggaacgctgacggaggaaaacggtgtagaacctgctttccatattgaaaacggcaagattgagggcaacggtttctacgcgacagcacgcactcgggagaacggcatcaatctttcgggaaatggttcgaccgaccccaaaaccttccaagctagtaatcttcgtgtagaagggggattttacggcccgcaggcggaggaattgggcggtattattttcaataatgatgggaaatctcttggtataactgaaggtactgaaaataaagttgatgttgaagctgaagttgatgctgaagttgatgttggcaaacagttagaatctgaagttaaacaccaattcggcgtggtattcggtgcgaagaaagatatgcaggaggtggaaaaatga

SEQ ID NO: 1138 - protein, 737 aa, N. meningitidis LbpB
MCKPNYGGIVLLPLLLASCIGGNFGVQPVVESTPTAYPVTFKSKDVPTPPPAGSSVETTPVNRPAVGAAMRLPRRNIASYKQDGTEIPDKHQAEEHLPLKEKDILFLDGTLKEQADKLKKKINERYSDVRVITSKKEEEKYQYQFVRAGYVFTRAEGKDNEKEKTSDGKEFVNRFSYDGFVYYSGERPSQSLPSAGTVQYSGNWQYMTDAKRHRTGKAVSSTDLGYTTYYGNEIGATSYEARDADDREKHPAEYTVDFDNKTLNGKLIKNQYVQNKSNPNEPKKPLTIYDITATLDGNRFTGSAKVSTEVKTQHADKEYLFFHTDADQRLEGGFFGDNGEELAGRFISNDNSVFGVFAGKQKTETENAADTKPALSSGKHTKILDSLKISVDEASDKNPREFAISSMPDFGHPDKLLVEGREIPLVNKEQTIELADGRKTTIRTCCDFLTYVKIGRMQTERPAAKPKAQDEERDEEDTGVDSVEEGEDEIDDEEGTEDAAVKDEGSEEDEAVEGEDEAEEPEEESPTEEGGSGSDGILPAPEAPKGRNIDLFLKGIRTAETDIPKTGEAHYTGTWEARIGKPIQWDNQADKEAAKAVFTVDFGKKSISGTLTEENGVEPAFHIENGKIEGNGFYATARTRENGINLSGNGSTDPKTFQASNLRVEGGFYGPQAEELGGIIFNNDGKSLGITEGTENKVDVEAEVDAEVDVGKQLESEVKHQFGVVFGAKKDMQEVEK

SEQ ID NO: 1139 - DNA, 2226 bp, N. lactamica LbpB
atgtgtaaactgaattatggcggcattgccttgctgccgttgatgctggcagcctgtggcggcaatttcggcgtgcagcctgttgccaaaccaacgccgatcgcgcaaaccccgtcagattccaaaccgtccaaacctgaggacgttcctactccgccccctgccaaaccctctatagaaaccacgccggtcaatcaacccgccgtcggtgcggcaatgcggctgccaaggcggaatattgcttcctataaacaagacggtacggaaattcccgacaagcatcaggcggaggagcatctgccgcttaaagagaaggatatcctgtttttagacggtacgctgaaagaacaggctgacaaacttaaaaagaaaatcaacgaacggtattctgatgtgagggttatcacatcgaaaaaagaagaagaaaaatatcaatatcaatttgtccgtgcgggctatgtgtttaccagggcggaaggaaaggataatgaaaaagaaaagacttctgatggtaaggagtttgttaaccgatttagttatgacggttttgtatattattccggagaacgtccttcccaatctttaccgagcgcgggaacggtgcaatattccggtaactggcaatatatgaccgatgccaaacgtcatcggacaggtaaggcggtttccagtacggatttgggttataccacatattatggtaatgaaattggggcaacttcttatgaggctagggatgccgacgacagggaaaagcatcctgccgaatatacggttgattttgataacaaaaccctgaatggcaagctgattaaaaatcagtatgtgcaaaataaaagtaatccaaatgagcccaaaaaaccgctgaccatttacgacattactgcaaaattggacggcaaccgctttaccggcagtgccaaagttaacaccgaggtgaagaagagccacgctgataaagagtatttgtttttccataccgatgccgatcagcggcttgagggcggtttttttggcgataagggggaagagcttgccggacggtttatcagtaacgacaacagcgtattcggcgtattcgcaggcaggcaaaaaacagacgcatcaaacgcatcaggcacaaatcctgctatgccgtctgaaaaacacaccaaaatcttggattctctaaaaatttccgttgacgaggcggctgatgaaaaagcccgtacgtttgccatttcctctatgcccgatcttggtcatcccgacaaacttcttgtcgaagggcgtgaaattcctttggtaaaccaagagaaaaccatcaatcttgccgacggcaggaaaatgaccgtccgtgcttgttgcgattttctgacctatgtgaaactcggacggataaaaaccgaccgcccggcaagtaaaccaaaggcggaagataaaagggaggatgaagagagtgcaggcgttgataacggcgaagaaggcacggaagatgaagccgcagaaggcagcgaaggagccgaagacgaaatcggcgatgaagaagaaggcacgggagatgaagccgtagaaggtgaagacggcgaagaagacgaaggtgaagaagctgaagaacccgaagaagaatcgccggcagaaggcggcggcggttcagacggcatcctgcccgctccggaagcccctaaaggcagggacatcgaccttttcctgaaaggtatccgcacggcggaagccgacattccaaaaaccggaacggcgcattatacgggcacttgggaagcgcgtatcagcaaacccattcaatgggataataaggcggataaagcggcaaaagcagagtttaatgttgatttcggcaagaaatcgatttccggaacgctgacggagaaaaacggtgtagaacctgctttccgtattgaaaacggcgtgattgatggcaacggtttccacgcaacagcacgcactcgggataacggcatcaatctttcgggaaatggttcgactaatcctcaaagtttcaaagccgacaatcttcttgtaacgggcggcttttacggcccgcaggcggaggaattgggcggtactattttcaataatgatgggaaatctcttgatataactgaagatactgaaaatgaagctgaagctgaagctggtgttgacgaacagttagaacctgaagctaaaccccaattcggcgtggtattcggtgcgaagaaagataataaagaggtggaaaaatga

SEQ ID NO: 1140 - protein, 741 aa, N. lactamica LbpB
MCKLNYGGIALLPLMLAACGGNFGVQPVAKPTPIAQTPSDSKPSKPEDVPTPPPAKPSIETTPVNQPAVGAAMRLPRRNIASYKQDGTEIPDKHQAEEHLPLKEKDILFLDGTLKEQADKLKKKINERYSDVRVITSKKEEEKYQYQFVRAGYVFTRAEGKDNEKEKTSDGKEFVNRFSYDGFVYYSGERPSQSLPSAGTVQYSGNWQYMTDAKRHRTGKAVSSTDLGYTTYYGNEIGATSYEARDADDREKHPAEYTVDFDNKTLNGKLIKNQYVQNKSNPNEPKKPLTIYDITAKLDGNRFTGSAKVNTEVKKSHADKEYLFFHTDADQRLEGGFFGDKGEELAGRFISNDNSVFGVFAGRQKTDASNASGTNPAMPSEKHTKILDSLKISVDEAADEKARTFAISSMPDLGHPDKLLVEGREIPLVNQEKTINLADGRKMTVRACCDFLTYVKLGRIKTDRPASKPKAEDKREDEESAGVDNGEEGTEDEAAEGSEGAEDEIGDEEEGTGDEAVEGEDGEEDEGEEAEEPEEESPAEGGGGSDGILPAPEAPKGRDIDLFLKGIRTAEADIPKTGTAHYTGTWEARISKPIQWDNKADKAAKAEFNVDFGKKSISGTLTEKNGVEPAFRIENGVIDGNGFHATARTRDNGINLSGNGSTNPQSFKADNLLVTGGFYGPQAEELGGTIFNNDGKSLDITEDTENEAEAEAGVDEQLEPEAKPQFGVVFGAKKDNKEVEK

SEQ ID NO: 1141 - DNA, 2190 bp, N. gonorrhoeae LbpB
atgcgtaaactgaattattacggtattgccttgctgccgttgatgctggcatcctgcggcggcaatttcggcgtgcagcctgttgtcgaatcaacgccgaccgcgtaccccgtcactttcaagtctaaggacgttcccacttccccccctgccgagccttcggtagaaaccacgccggtcaaccggcccgccgtcggtgcggcaatgcggttgttgaggcggaatactgcttttcatcgtgaagatggcacggcaattcccgatagcaaacaagcagaagaaaagctgtcgtttaaagaaggtgatgttctgtttttatacggttcaaaaggaaataaacttcaacaacttaaaagcgaaattcataaacgtgattccgatgtagaaattaggacgtcagaaaaggaaaataaaaaatataattataaatttgtggatgccggttatgtatatactaaaaacggaaaagatgaaatcgaacagaactcaggtggtaagcggtttacccaccgttttggttatgacggttttgtatattattccggagaacgtccttcccaatctttaccgagcgcgggaacggtgcaatattccggcaactggcaatatatgaccgatgccaaacgtcatcggacaggtaaggcggttgccagtgacgatttgggttatataacattttatggtaacgatattggtgcaacttcttatgcggctaaggatgccgacgacagggaaaaacatcctgccgaatatacggttgatttcgacaaaaaaatcctaaagggcgagctgattaaaaatcagtatgtgcaaaagagaaatgatccaaaggaacctaaaaaaccgctgaccatttacaacatcactgccgatttaaacggcaaccgctttaccggcagtgccaaagttaacaccgaggtgaagacgagacacgctgataaagaatatttgtttttccataccgatgccgatcagcggcttgagggcggttttttcggcgataacggagaagagcttgccggacggtttatcagtaacgacaacggcgtattcggcgtattcgcaggcaaacaaaaaacaaacgcatcaggcacaaatcctgctatgccgtttggaaaacacaccaaaatcttggattctctaaaaatttccgttgacgaggcgactgatgaaaatccccgtccgtttgaggtttccactatgcccgattttggtcatcctgacaaacttcttgtcgaagggcgtgaaattcctttggttagcaaagagaaaaccatcgatcttgccgacggcaggaaaatgaccgtcagtgcttgttgcgactttttgacctatgtgaaactcggacggataaaaaccgaacgccccgccgtcaaaccgaaggcgcaggacgaagaggattcgggtattaataacggtgaagaaagcgaagacgaagaaatcgccgaagaaagcgaagacgaagtttccgaagatgataacggcgaagacgaagacgaaatcgtcgaagaagaagctgatgaagctgaagaaatcgaagaagaagctgaagaggaagaacccgaagaagaatcgccggaagaaggcaacggtgtttcagacggcatcccgcccgccccggaagcccttaaaggcagggacatcgaccttttcctgaaaggtatccgcacggcggaagccgacattccaaaaaccggaacggcgcattataccggcacttgggaagcgcgtatcggcgaacccattcaatgggataataaggcggataaagcggcaaaagcagaatttgacgttgatttcggcaataaatcgatttccggaacgctgacggagcaaaacggtgtagaacctgctttccgtattgaaaacggcgtgattgagggcaacggtttccacgcaacagcacgcactcgggataacggcatcaatctttcgggaaatggttcgactaatcctcaaagtttcaaagccgacaatcttcttgtaacgggcggcttttacggcccgcaggcggcggaattgggcggcactattttcaataaggatgggaaatctcttggtataactgaagatattgaaaatgaagttgaaaatgaagctgatgttggcgaacagttagaacctgaagttaaaccccaattcggcgtggtattcggtgcgaagaaagataataaagaggtggaaaaatga

SEQ ID NO: 1142 - protein, 729 aa, N. gonorrhoeae LbpB
MRKLNYYGIALLPLMLASCGGNFGVQPVVESTPTAYPVTFKSKDVPTSPPAEPSVETTPVNRPAVGAAMRLLRRNTAFHREDGTAIPDSKQAEEKLSFKEGDVLFLYGSKGNKLQQLKSEIHKRDSDVEIRTSEKENKKYNYKFVDAGYVYTKNGKDEIEQNSGGKRFTHRFGYDGFVYYSGERPSQSLPSAGTVQYSGNWQYMTDAKRHRTGKAVASDDLGYITFYGNDIGATSYAAKDADDREKHPAEYTVDFDKKILKGELIKNQYVQKRNDPKEPKKPLTIYNITADLNGNRFTGSAKVNTEVKTRHADKEYLFFHTDADQRLEGGFFGDNGEELAGRFISNDNGVFGVFAGKQKTNASGTNPAMPFGKHTKILDSLKISVDEATDENPRPFEVSTMPDFGHPDKLLVEGREIPLVSKEKTIDLADGRKMTVSACCDFLTYVKLGRIKTERPAVKPKAQDEEDSGINNGEESEDEEIAEESEDEVSEDDNGEDEDEIVEEEADEAEEIEEEAEEEEPEEESPEEGNGVSDGIPPAPEALKGRDIDLFLKGIRTAEADIPKTGTAHYTGTWEARIGEPIQWDNKADKAAKAEFDVDFGNKSISGTLTEQNGVEPAFRIENGVIEGNGFHATARTRDNGINLSGNGSTNPQSFKADNLLVTGGFYGPQAAELGGTIFNKDGKSLGITEDIENEVENEADVGEQLEPEVKPQFGVVFGAKKDNKEVEK

SEQ ID NO: 1143 - DNA, 2070 bp, N. cinerea LbpB
atgtgtaaactgaattattacggtattgccttgctgccgttgatgctggcatcctgcggcggtaatttcggcgtgcagcctgttgccaagtcaacgccgaccgtacaaaccccgtcagattccaaaccttccaagcctgaggatattcctgctccggctcctgccaaaccttctatagaaatcactccggtcaatcagcccgccgtcggtgcggcaatgcggctgccaaggcggaatatggctttctataaacaagacggtacggaaattcctggcaagcatcaggcggaggattatttgccgcttaaagaggaggatatcctgtttttagacggtgcgccgcaagaacaggccgacaaacttaaaaagaaaatcgacgaacggtatcctaatgtaaaaatctacacgtccgattcaaaagatgatgcgtatcaatataaatatgtccgggccggatatgtttatactaaagaaggaaaagacgaaatcaaacagaccccaggcggtaagcggtttacccaccggtttggttatgacggttttgtatattattccggagaacatccttcccaatctttaccgagtgcgggaacggtgaaatattccggtaactggcaatatataactgatgccaaacgtcatcggacaggtcaggcggttgccagtgaggatttgggttatatcacatattatggtaacgatattggtgcaacttcttatgcggctagggatgccgacgacagggaaaaacatcctgccgaatatacggtagatttcggtaacaaaaccctgacgggcgacctgattaaaaaccaatatgtcaaaccccacgagaaaaaaaagccgctgaccatttacaacattactgcaaaattggacggaaaccgctttaccggcagtgccaaggtcaatcctgatttagcgaaaaaccctgccggtaaggagcgtttgtttttccatgacgatgccgatcagcggcttgagggcggttttttcggcgataacggagaagagcttgccggacggtttatcagcaacgacaacagcgtattcggcgtattcgcaggcaaacaaaatagctccgtgccgtctgaagcacataccaaaatcttggattcgctgaagattgccgccgacgaagctgccgatcctaaggcacgtccgtttattgctgagcctatgcccgactttgcccatcctgacaaactccttgtcgaaggacgtgaaatctccttgctcaaagatactcaaaccatcgttcttgccgatggtaggaaaacgacaatccgaacctgttgcgattttctgacctatgtgaaaatcggacggatgcaaaccgaccgtcccgtcatcaaaccgactccaacagaggatgaagattccgatcatgaaggcgcgggacctgatgatgaaaatgaaggtttagagcctgaagacggtgaagacggtttggaaaatgataccgatgacggtcatgcttcttccgagttgccgacggagaaagataacggggaagcaaatacagcaggaaaaaatgaaggaaacaacgcggaaagcgtaggtacggatggaaaaccacctgtccaacccgcttctgcatacaggaatatcgaccttttcataaaaggtatccgcacttccgaggcagacatccctaaaattgggaatgtccactatagaggttcatgggaagcccgtatcggcgcgccgatccaatgggataaccatgcggataaagcggcaaaagccgaattcgacgttaactttgctaacaagtccctttccggcaccctgacggagaaaaatggcgtagaacctgccttctatattgaaaaaggtattattgagcacaacggtttccatgcagtggcacgtacccgtgatacaggtatcgacctgcttggcaggggtgcaacatcctccaaaccatttaaagccgagaaccttcatgtaacggggggcttttacggtcctcatgcatcggaattgggcggcagctttgccgaacctcaacaaaaaatcggtgtggtatttggtgcgaagaaagatgacaaggaggcaacacgatga

SEQ ID NO: 1144 - protein, 689 aa, N. cinerea LbpB
MCKLNYYGIALLPLMLASCGGNFGVQPVAKSTPTVQTPSDSKPSKPEDIPAPAPAKPSIEITPVNQPAVGAAMRLPRRNMAFYKQDGTEIPGKHQAEDYLPLKEEDILFLDGAPQEQADKLKKKIDERYPNVKIYTSDSKDDAYQYKYVRAGYVYTKEGKDEIKQTPGGKRFTHRFGYDGFVYYSGEHPSQSLPSAGTVKYSGNWQYITDAKRHRTGQAVASEDLGYITYYGNDIGATSYAARDADDREKHPAEYTVDFGNKTLTGDLIKNQYVKPHEKKKPLTIYNITAKLDGNRFTGSAKVNPDLAKNPAGKERLFFHDDADQRLEGGFFGDNGEELAGRFISNDNSVFGVFAGKQNSSVPSEAHTKILDSLKIAADEAADPKARPFIAEPMPDFAHPDKLLVEGREISLLKDTQTIVLADGRKTTIRTCCDFLTYVKIGRMQTDRPVIKPTPTEDEDSDHEGAGPDDENEGLEPEDGEDGLENDTDDGHASSELPTEKDNGEANTAGKNEGNNAESVGTDGKPPVQPASAYRNIDLFIKGIRTSEADIPKIGNVHYRGSWEARIGAPIQWDNHADKAAKAEFDVNFANKSLSGTLTEKNGVEPAFYIEKGIIEHNGFHAVARTRDTGIDLLGRGATSSKPFKAENLHVTGGFYGPHASELGGSFAEPQQKIGVVFGAKKDDKEATR

SEQ ID NO: 1145 - DNA, 2847 bp, M. catarrhalis LbpB; identical to SEQ ID NO: 869

SEQ ID NO: 1146 - protein, 948 aa, M. catarrhalis LbpB
LSFCLVVCLWELIVLTLVVDAWADLIKRSSQHTKRDITMSTVKTPHIFYQKRTLSLAIASIFAALVMTGCRSDDISVNAPNVTQLPQGTVSPIPNTGHDNTNNTNNQGNNTDNSTSTTDPNGDNNQLTQAQKTAAAAGFFVMGKIRDTSPKNDPDYGDDLKQQWLGKLYVGIDAHRPDGIGKGKNLRQPITANDIKPLYFNKFPALSDLHLDSERHRFDPQKINTIKVYGYGNLTTPSNNNTHINHQQADNAKAKKPTDAYENIRFGYLELQGSSLTQKNADNQNDQDRIPKPMPILFYHGENASSQLPSAGKFNYTGNWLYLSDVKKRPALSASDDRVGVYLNASGKANEGDVVSAAHIYLNGFQYKHTPATYQVDFDTNSLTGKLSYYDNPNKKTAQGEYLKSQFDTSKKVNETDVYQIDAKINGNRFVGTAKSLVNENTKTAPFIKELFSKKANPNNPDPNSDTLEGGFYGKSGDELAGKFLSNDNATYVVFGGKRDKTAEPVATKTVYFSAGFEKPSTSFVDNETIGRIINSKGLNDNIEEDAITPSDNSYYEYNWGKPEKQFTKKVSSSTQAVPAYFGQHDKFYFNGNYYDLSASSVDKLAPADAVKANQSIKEKYPNATLNKDKVTTIVLQEAKDNKPYTAIHAKSYDHISFGEVLYNDNKGNPTRSYFVQGGQADVSTQLPSAGKFTYNGLWAGYLAQKKDKGYSNKEETIKAKGHQDYLLTEDFTPEDDDNDLIASDDSQDDNTHGDDDLIASDDSQDDNTHGDDDLIASDDSQDDDADGDDDSDDLGDGADDDAAGKVYHAGNIRPEFENKYLPINEPTHEKTFALDGKNKAKFDVDFDTNSLTGKLNDERGDIVFDIKNGKIDGTGFTAKADVPNYREEVGNNQGGGFLYNIQDIDVKGQFFGTNGEELAGQLQYDKGDGINDTAEKAGAVFGAVKDK

SEQ ID NO: 1147 - DNA, 1803 bp, N. gonorrhoeae TbpB
atgaaaaaatcacttattgcccaagcagccggcatcctgcctgtgctgctgctttctgcctgcgcgggcggcggcagtttcgatttggacagtgtggaaacgaaacagcacaacccgcagtccgaagcaccgaaataccaagacgaacagactgaaaaaccggcaaaacccgatgaagcgcaggcggaaaacgaccgtccggcttacggttttgcagtcaaaataccgcgccggttctggtacccgagaaataaagaagatcataaggcattatcagaagcggattgggagaaattaggtgcgggtgcgccgaatgagtttccccaaaagaatgaaatctcgaatatgactgaaggaactctgaacgagtctattcagccgggtgaggacggcaaaagccgcgtggaaggatacacgaaattcgagtatgtccgctcgggctatatctaccgcaacggcttgccgatggaaagaatcgatggcagtgtgcgcaacggtccgaaaggctaccttttctacaaaggcagtaatccttcccaagctctgccgacgggcaaggcgatttacaaaggtacttgggattatgtaaccgatgccaagatgggacaaaagttttcccagttgggtggttcgcaagcgggggacaggtacggggctttgtctgccgaggaagcggatgtgttgcgcaacaaaaacgaggcgaaggaaggtaccgatttcgggctgaccagcgagtttgaggtggatttcgctgccaagactatgaccggcaaactctaccgcaataaccggattacccataacgaaaccgaaaatagagacaaacaaattaaacgttacgacattcaggctgacctgcacggcaaccgcttcaaaggtaaggcggtggcagcagataaaggcgcaacaaatggaagtcatccctttatttccgattccgacagtttggaaggcggattttacggaccgaaaggcgaggaacttgccggtaaattcttgagcaacgacaacaaagttgcagcggtgtttggtgcgaagcagaaagataagaaggagggggaaaacacggcagagcttgcaacggaaaccgtgatagatgcataccgtattaccggaggggggtttaagaaagagcaaatagacagttttggagatgtgaaaaagctgctggttgacggagtggagctttcactgctgccgtctgagggcaataaggcggcatttcagcacgggattgagcaaaacggcgtgaaggcaacggtgtgttgttccaacttggattacatgagttttgggaagctgtcaaaagaaaataaagacgatatgttcctgcaaggtgtccgcactccggtatccgatgtggcggcaaggacggaggcaaacgccaaatatcgcggtacttggtacggatatattgccaacggcacaagctggagcggcgaagcctccaatcaggaaggcggtaatagggcagagtttgacgtggatttttccactaaaaaaatcagtggcacactgacggcaaaagaccgtacgtctcccacgtttatcattaccgccgcgattcaggacaacggttttgaaggtacggcgaaaaccggtgaaaacggctttgcattagatccgaaaaataccggaaattcccactatgcgcatattgaagccactgtatccggcggtttctacggcaaaaacgccattgagatgggcggttcattctcatttccgggaaatgcaccggagggaaaacaagaaaaagcatcggtggtattcggtgcgaaacgccaacagcttgtgcaataa

SEQ ID NO: 1148 - protein, 600 aa, N. gonorrhoeae TbpB
MKKSLIAQAAGILPVLLLSACAGGGSFDLDSVETKQHNPQSEAPKYQDEQTEKPAKPDEAQAENDRPAYGFAVKIPRRFWYPRNKEDHKALSEADWEKLGAGAPNEFPQKNEISNMTEGTLNESIQPGEDGKSRVEGYTKFEYVRSGYIYRNGLPMERIDGSVRNGPKGYLFYKGSNPSQALPTGKAIYKGTWDYVTDAKMGQKFSQLGGSQAGDRYGALSAEEADVLRNKNEAKEGTDFGLTSEFEVDFAAKTMTGKLYRNNRITHNETENRDKQIKRYDIQADLHGNRFKGKAVAADKGATNGSHPFISDSDSLEGGFYGPKGEELAGKFLSNDNKVAAVFGAKQKDKKEGENTAELATETVIDAYRITGGGFKKEQIDSFGDVKKLLVDGVELSLLPSEGNKAAFQHGIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPTFIITAAIQDNGFEGTAKTGENGFALDPKNTGNSHYAHIEATVSGGFYGKNAIEMGGSFSFPGNAPEGKQEKASVVFGAKRQQLVQ

SEQ ID NO: 1149 - DNA, 1800 bp, N. meningitidis TbpB; identical to SEQ ID NO: 1093

SEQ ID NO: 1150 - protein, 599 aa, N. meningitidis TbpB; identical to SEQ ID NO: 1094

SEQ ID NO: 1151 - DNA, 1800 bp, N. polysaccharea TbpB
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaagagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataatttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcagcagataaaggtgcaacaaatggaagtcatccctttatttccgactccgacagtttggaaggcggattttacggaccgaaaggcgaggaacttgccggtaaattcttgagcaacgacaacaaagttgcagcggtgtttggtgcgaagcagaaagataagaaggagggggaaaacgcggcagggcctgcaacggaaaccgtgatagatgcataccgtattaccggaggggagtttaagaaagagcaaatagacagttttggagatgtgaaaaagctgctggttgacggggtggagctttcactgctgccgtctgagggcaataaggcggcatttcagcacgggattgagcaaagcggcgtgaaggcaacggtgtgttgttccaacttggattacatgagttttgggaagctgtcaaaagaaaataaagacgatatgttcctgcaaggtgtccgcactccagtatccgatgtggcggcaaggacggaggcaaacgccaaatatcgcggtacttggtatggatatattgccaacggcacaagctggagcggcgaagcctccaatcaggaaggcggtaatagggcagagtttgacgtggatttttccactaaaaacatcagtggcacactgacggcaaaaaaccgtacgtctcctgcgtttactattactgccacgattcagggcaacggtttttccggtacggcgaaaaccggtaatgacggctttgcgctggatccgcaaaataccggaaattcccactatacgcatattgaagccactgtatccggcggtttctacggcaaaaacgccatcgagatgggcggttcgttctcatttccgggaaatgcaccggagggaaaacaagagaaagcatcggtggtattaggtgcgaaacgccaacagcttgtgcaataa

SEQ ID NO: 1152 - protein, 599 aa, N. polysaccharea TbpB
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKIIYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKEGENAAGPATETVIDAYRITGGEFKKEQIDSFGDVKKLLVDGVELSLLPSEGNKAAFQHGIEQSGVKATVCCSNLDYMSFGKLSKENKDDMFLQGVRTPVSDVAARTEANAKYRGTWYGYIANGTSWSGEASNQEGGNRAEFDVDFSTKNISGTLTAKNRTSPAFTITATIQGNGFSGTAKTGNDGFALDPQNTGNSHYTHIEATVSGGFYGKNAIEMGGSFSFPGNAPEGKQEKASVVLGAKRQQLVQ

SEQ ID NO: 1153 - DNA, 1779 bp, N. flavescens TbpB
atgaaaaaatcacttattgcccaagcagccggcatcctgcctgtgctgctgctttctgcctgcgcgggcggcggcagtttcgatttggacagcgtggaaacgaaaccgcacaacccgcagcccgaagcaccgaaatatcaagacgaacagaccgaaaaaccggcaaaacccgatgaggcgcaggcggcggaaaacgaacgttctgcttacggttttgcagccaaaataccgcgtcggaactggtacaaaaataaagaagatcataaggcattatcagaagcggattgggagaaattaggtgcgggtgagccgggtgagtttcgccaaaagaatgagatttttgcgatggataagggtacgctgaacgaatccatcacaacgggcgacggcaaaagccgtgtggaaggatacacggctttcaagtatgtcggctcgggctatatctaccgcaacggtgccaataaaatcgatctcaaaaacgatatcgcccttttcggtccggacggctaccttttctacaaaggcagtaatccttcccaagctctgccgacgggcaaggcgatttataaaggtacttgggattatgtaaccgatgccaagggaaaacagaagtttccccagttgggtagtccgccagcgggggataggtacggggctttgtctgccgaggaagcggatgtgttgcgcaatgaaagcgaggcaccggaaggtcagaccgatttcgggctgaccagcgagtttaaggtggacttcgccgccaagaccatgaccggcgcgctctaccgcaataaccggattacccataacgaaaccgaaaataaaaccaaacaaattaaacggtacgacattcaggctaacctgcacggcaaccgcttcaaaggtaaggcgttggccgcggataaagatactgggaacggtcatcccttcgtttctgattctgacagtctggaaggtggtttctacgggcctcagggcgacgagttgggcggtaagtttttggcaaaagataagaaagtgcttgccgtattcagcgcgaaacagaaagacggtgcagaaaaaccattggctgaaacctttatggacgcttaccgcatcggtgcggattttgtgaaaaaacagatagacagcttcggcaacgtggccaaactgctgattgacggcgtggagctttcactgctgccgtctgagggcaataaggcggcatttcaacacgggattgagcaaaacggcgtgaaggcaacggtgtgttgttccaacttggattacatgagttttgggaagctgtcaaaagaaaataaagacgatatgttcctgcaaggtgtccgcactccggtatccgatgtggcggcaaggacggaggcaaacgccaaatatcgcggcacttggtacggatatattgttaacggtacgagctggagcggcgaagcctccaatcaggaaagtggtaatagggcagagtttgacgtgaattttgccaagaaaaccctcaacggtatgctgacggcgaaagatcgcattgaccctgcattcaccatcactgcccagattcagggcaacggtttttcaggtgtggcgaaaaccggtgaaaaaggctttgcattggatccaaaaagtaccatcgatccggtctatacgcacattcaggcggatgtatccggtggcttctacggcaaaaacgccattgagatgggcggatcgttctccggaaacacattggggggagaaaacggcaaggcggcagtggtatttggtgcgaaacgccaacagcttgtgcaataa

SEQ ID NO: 1154 - protein, 592 aa, N. flavescens TbpB
MKKSLIAQAAGILPVLLLSACAGGGSFDLDSVETKPHNPQPEAPKYQDEQTEKPAKPDEAQAAENERSAYGFAAKIPRRNWYKNKEDHKALSEADWEKLGAGEPGEFRQKNEIFAMDKGTLNESITTGDGKSRVEGYTAFKYVGSGYIYRNGANKIDLKNDIALFGPDGYLFYKGSNPSQALPTGKAIYKGTWDYVTDAKGKQKFPQLGSPPAGDRYGALSAEEADVLRNESEAPEGQTDFGLTSEFKVDFAAKTMTGALYRNNRITHNETENKTKQIKRYDIQANLHGNRFKGKALAADKDTGNGHPFVSDSDSLEGGFYGPQGDELGGKFLAKDKKVLAVFSAKQKDGAEKPLAETFMDAYRIGADFVKKQIDSFGNVAKLLIDGVELSLLPSEGNKAAFQHGIEQNGVKATVCCSNLDYMSFGKLSKENKDDMFLQGVRTPVSDVAARTEANAKYRGTWYGYIVNGTSWSGEASNQESGNRAEFDVNFAKKTLNGMLTAKDRIDPAFTITAQIQGNGFSGVAKTGEKGFALDPKSTIDPVYTHIQADVSGGFYGKNAIEMGGSFSGNTLGGENGKAAVVFGAKRQQLVQ

SEQ ID NO: 1155 - DNA, 1800 bp, N. lactamica TbpB
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaagagccagcctgaaagccaacaggatgtatcggaaaacagcggcgcggcttatggctttgcagtaaaactacctcgccggaatgcacattttaatcctaaatataaggaaaagcacaaaccattgggttcaatggattggaaaaaactgcaaagaggagaaccaaatagttttagtgagagggatgaattggaaaaaaaacggggtagttctgaacttattgaatcaaaatgggaagatgggcaaagtcgtgtagttggttatacaaatttcacttatgtccgttcgggatatgtttaccttaataaaaataatattgatattaagaataatatagttctttttggacctgacggatatctttactataaagggaaagaaccttccaaggagctgccatcggaaaagataacttataaaggtacttgggattatgttactgatgctatggaaaaacaaaggtttgaaggattgggtagtgcagcaggaggagataaatcgggggcgttgtctgcattagaagaaggggtattgcgtaatcaggcagaggcatcatccggtcataccgattttggtatgactagtgagtttgaggttgatttttctgataaaacaataaagggcacactttatcgtaacaaccgtattactcaaaataatagtgaaaacaaacaaataaaaactacgcgttacaccattcaagcaactcttcacggcaaccgtttcaaaggtaaggcgttggcggcagataaaggtgcaacaaatggaagtcatccctttatttccgactccgacagtttggaaggcggattttacggaccgaaaggcgaggaacttgccggtaaattcttgagcaacgacaacaaagttgcagcggtgtttggtgcgaagcagaaagataagaaggagggggaaaacgcggcagggcctgcaacggaaaccgtgatagatgcataccgtattaccggcgaggagtttaagaaagagcaaatagacagttttggagatgtgaaaaagctgctggttgacggagtggagctttcactgctgccgtctgagggcaataaggcggcatttcagcacgagattgagcaaaacggcgtgaaggcaacggtgtgttgttccaacttggattatatgagttttgggaagctgtcaaaagaaaataaagacgatatgttcctgcaaggtgtccgcactccagtatccgatgtggcggcaaggacggaggcaaacgccaaatatcgcggtacttggtacggatatattgccaacggcacaagctggagcggcgaagcctccaatcaggaaggcggtaatagggcagagtttgacgtggatttttccactaaaaaaattagtggcacactgacggcaaaagaccgtacgtctcctgcgtttactattactgccacgattcagggcaacggtttttcaggtgtagcgaaaaccggtgaaaacggctttgcattagatccgaaaaataccatcgatccgggctatacgcgcattcaggcggatgtatccggcggcttctacggcaaaaacgccatcgagatgggcggttcgttctcatttccgggaaatacaccggagggagaacaagaaaaagcatcggtggtattcggtgcgaaacgccaacagcttgtgcaataa

SEQ ID NO: 1156 - protein, 599 aa, N. lactamica TbpB
MNNPLVNQAAMVLPVFLLSACLGGGGSFDLDSVETVQDMHSKPKYEDEKSQPESQQDVSENSGAAYGFAVKLPRRNAHFNPKYKEKHKPLGSMDWKKLQRGEPNSFSERDELEKKRGSSELIESKWEDGQSRVVGYTNFTYVRSGYVYLNKNNIDIKNNIVLFGPDGYLYYKGKEPSKELPSEKITYKGTWDYVTDAMEKQRFEGLGSAAGGDKSGALSALEEGVLRNQAEASSGHTDFGMTSEFEVDFSDKTIKGTLYRNNRITQNNSENKQIKTTRYTIQATLHGNRFKGKALAADKGATNGSHPFISDSDSLEGGFYGPKGEELAGKFLSNDNKVAAVFGAKQKDKKEGENAAGPATETVIDAYRITGEEFKKEQIDSFGDVKKLLVDGVELSLLPSEGNKAAFQHEIEQNGVKATVCCSNLDYMSFGKLSKENKDDMFLQGVRTPVSDVAARTEANAKYRGTWYGYIANGTSWSGEASNQEGGNRAEFDVDFSTKKISGTLTAKDRTSPAFTITATIQGNGFSGVAKTGENGFALDPKNTIDPGYTRIQADVSGGFYGKNAIEMGGSFSFPGNTPEGEQEKASVVFGAKRQQLVQ

SEQ ID NO: 1157 - DNA, 1782 bp, N. cinerea TbpB
atgaaaaaattacttattgcccaagcagccggcatcctgcctgtgctgctgctttctgcctgcgcgggcggcggcagtttcgatttggacagcgtggaaacgaaacagcgcaacccacagtccgaagcaccgaaataccaagacgaacagactgaaaaaccggcaaaacccagtgaagcgcaggcagcggaaaacgaacgttcggcttacggttttgcagccaaaataccgcgtcggaatatccatttcaacgtgaagcaggggcatcagccgctgtcggatgcggattgggtgaaattggcggcgggtgaaccggataagtttccccaaaaggatgacatttttgcgatggataagggtacgctgaacgaatccatcacaacgggcgacggcaaaagccgcgtggaaggatacacgaaatttaagtatgtccgctcgggctatatctaccgcaacggtgccaataagatcgatcccaaaaacaatatcgcccttttcggtccggacggctaccttttctacaaaggcagcaatccttcccaagctctgccgacgggcaaggcaatttacaaaggtacttgggattatgtaaccgatgccaaggaaaaacagaagtttccccagttgggtagtccgccagcgggggataggtacggggctttgtctgcagaggaagcggatgttttgcgcaatgaaagcgaggcaccgaaaggtcagaccgatttcgggctgaccagcgagtttgaggtggatttcgccgccaagactatgaccggcgcgctctaccgcaataaccggattacccataacgaaaccgaaaataaagccaaacaaattaaacgttacgacattcaggctaacctgcacggtaaccgtttcaaaggtaaggcgttggcagcggataaaaatgctaatgagaaagaacatcccttcgtttctgattctgatagtctggaaggtggtttctacgggcctcagggcgacgagttgggcggcaagtttttggcaaacgataagaaagtgcttgccgtattcagcgcgaaacagaaagacgatgcagaaaaaccattggctgaaacctttatggacgcttaccgcatcggtgcggattttgtgaaaaaacagattgacagcttcggcaacgtggccaaactgctgattgacggcgtggagcttgcgcttgtgccgtccgaaggcactcagacggcattccagcatgtatttgagaaagacggcgtgaaggtgtcggcatgctgctccaatttggattatctgcatttcggggtgttggaacacggcggttcgcacgacctgtttttgcagggcagccgtacggcagtatccgaaatgccgacaactgccgagccggcggtatatcgcggtacatggtcgggtactattgttaacggtacgagctggagtgccgaaccttccgataaggaaggcggtaaccgggcggagtttaaagttaattttgccgagaaaaccctcaacggtatgctgacggcgaaagaccgcattgcccccgtattcaccatcactgcccagattcagggcaacggtttttcaggtgtggcgaaaaccggtgaaaacggctttgcattagatccgaaaaataccatcgatccgatacggacgaatatccgtgcagatgtgtccggcggcttctacggcaaaaacgccatcgagatgggcggatcgttctccggaaatacattggagggaggaagcggcaaggcggcagtggtattcggtacgaaacgccaacagcttgtccggtaa

SEQ ID NO: 1158 - protein, 593 aa, N. cinerea TbpB
MKKLLIAQAAGILPVLLLSACAGGGSFDLDSVETKQRNPQSEAPKYQDEQTEKPAKPSEAQAAENERSAYGFAAKIPRRNIHFNVKQGHQPLSDADWVKLAAGEPDKFPQKDDIFAMDKGTLNESITTGDGKSRVEGYTKFKYVRSGYIYRNGANKIDPKNNIALFGPDGYLFYKGSNPSQALPTGKAIYKGTWDYVTDAKEKQKFPQLGSPPAGDRYGALSAEEADVLRNESEAPKGQTDFGLTSEFEVDFAAKTMTGALYRNNRITHNETENKAKQIKRYDIQANLHGNRFKGKALAADKNANEKEHPFVSDSDSLEGGFYGPQGDELGGKFLANDKKVLAVFSAKQKDDAEKPLAETFMDAYRIGADFVKKQIDSFGNVAKLLIDGVELALVPSEGTQTAFQHVFEKDGVKVSACCSNLDYLHFGVLEHGGSHDLFLQGSRTAVSEMPTTAEPAVYRGTWSGTIVNGTSWSAEPSDKEGGNRAEFKVNFAEKTLNGMLTAKDRIAPVFTITAQIQGNGFSGVAKTGENGFALDPKNTIDPIRTNIRADVSGGFYGKNAIEMGGSFSGNTLEGGSGKAAVVFGTKRQQLVR

SEQ ID NO: 1159 - DNA, 1812 bp, H. parahaemolyticus TbpB
atgtgttttaacaaaaaatggttttttattacttcccctttcttattaaatgcgtgttcaagtggcggaggatcttttgatgtcgatacggtgtcaaaagattcccctacaccaagtaaaaaacaatttaaagatgaagagtctcaattgacacctgtgccaagtaagaatctttctgcattgcaaagcccaacattaggtaccgcaatgaaattaaaagcacataatttatttgatcgcagtggaaaggagaatcttttttcagaagaagaatatgaaacgttagacttcaatatgataaaagcaagagtcgcagcatcaacagctgatggctctattgtggatagtaatgatggatccagtccttattttactcggcttttgaaatatgttcgttcaggagtttattacaatgatagctggagagaaagagatatacctaataaacgttttttatctggtttttatggctatgcattttattttggtgaaaacccatcaagagcgttaccagtagagggtaatgctcattataaagggacttgggactttattacgaatgttaaaaatggtagaacttatccattacttggaagtcaggcaggcaataagagaagtgctgtgccaaatgatattgatgatttgctaacgaataaaaatgatgcggttgatcctaattcaactgattttggtttaagcagtgagtttgacgttaactttggcaataaaacattaactgggcagttatatcgaaataaacgtcaaacgcttgcaaattcgtcagctaaaaaagaaaaagtttatgatttaaacgcaacgcttcacggtaatcgttttattggaaatgctgtcgctaccgataaaataagtcaagattatccatttacttctgatgcaaaagatgcgttagaaggaggattttatggccctcatggtgaggagttaggtggaaaatttttgacagatgacaagcgagtcttcactgtatttagtgcaaaacgaaatgatgaatcattaacagccgaaacacagtttgatgcaaaacaaatttccttttctgcagtaggaaatgggaatgttggagacgattttaacataaaagataccactacatttggtgaggtaaattatctagtggttggcaaccaacgtcttcctcttttagccagcgattcaacaacttctgcctttacaacaacatcagaacaccacgtaaaagagaacacagctgagaaaacgatagagacagttgtttgctgccaaaatctgaatagcgtaaaatttggtctttactatgataaagataataaagaacgtaagcagtatcatcaattccttatagggcagagaagttcgactaaagaaattgaggctttaaaaggaccagcattttatcgtggtacttgggatggttatatcactaatggggaaacctcttacacagcttctgcaacaaataagagtaccggagatatagctgagtttacggtgaattttgataataaaaccctgactggcgaattgaaaaaagcaggtagccttaatactgtttttgatattaacggtaaattagatggaaatagttttagtggtatggcttcaacaaagggtgatggctttgcactcgatactaaaaatacgctagattctacaaaagttcgtattaatactgaggtaaaaggggcattttatggagcaaaaggatctgaattagggggggcatttagtgctaacacactagatgatagtaacaaagccaaagctgctgttgtatttggagccaaacgtcaagttgaagtgacagctcaataa

SEQ ID NO: 1160 - protein, 603 aa, H. parahaemolyticus TbpB
MCFNKKWFFITSPFLLNACSSGGGSFDVDTVSKDSPTPSKKQFKDEESQLTPVPSKNLSALQSPTLGTAMKLKAHNLFDRSGKENLFSEEEYETLDFNMIKARVAASTADGSIVDSNDGSSPYFTRLLKYVRSGVYYNDSWRERDIPNKRFLSGFYGYAFYFGENPSRALPVEGNAHYKGTWDFITNVKNGRTYPLLGSQAGNKRSAVPNDIDDLLTNKNDAVDPNSTDFGLSSEFDVNFGNKTLTGQLYRNKRQTLANSSAKKEKVYDLNATLHGNRFIGNAVATDKISQDYPFTSDAKDALEGGFYGPHGEELGGKFLTDDKRVFTVFSAKRNDESLTAETQFDAKQISFSAVGNGNVGDDFNIKDTTTFGEVNYLVVGNQRLPLLASDSTTSAFTTTSEHHVKENTAEKTIETVVCCQNLNSVKFGLYYDKDNKERKQYHQFLIGQRSSTKEIEALKGPAFYRGTWDGYITNGETSYTASATNKSTGDIAEFTVNFDNKTLTGELKKAGSLNTVFDINGKLDGNSFSGMASTKGDGFALDTKNTLDSTKVRINTEVKGAFYGAKGSELGGAFSANTLDDSNKAKAAVVFGAKRQVEVTAQ

SEQ ID NO: 1161 - DNA, 1779 bp, A.pleuropneumoniae TbpB
atgcattttaaacttaatccctatgcgttagcgtttacttcgctgtttcttgtcgcttgttctggcggaaaaggaagttttgatttagaagatgtccggccaaatcaaactgcaaaagcagaaaaagcaacaacctcttatcaagatgaggaaacgaagaaaaagacaaaggaagaattagataagttgatggagcctgctttggggtatgaaactcaaattttacggcgaaataaggctcctaaaacagaaacaggagagaaaaggaatgagagagttgttgagttatccgaagataaaattacgaaattataccaagagagtgtagaaataatccctcatttagatgagctaaatggaaaaacaacgagcaatgatgtttatcattctcacgatagtaaaaggcttgataagaatagagatctcaaatatgttcgttcaggttatgtttatgatgggtctttcaatgaaatacgacgaaatgactcaggattccatgtttttaaacagggtatagatggctatgtctattaccttggagttactccatcaaaagagttaccaaaaggaaaagtcataagttataaaggtacttgggattttgtaagtaacatcaatttagatcgtgaaatagatggattcgacacttcaggtgatggtaaaaatgtatctgcaacatctattacagaaactgtcaatcgagatcataaagttggtgaaaaactaggtgataatgaagttaaaggggtagctcattctagtgaatttgcagtagattttgataacaaaaaattgacaggtagtttatatcgtaatggttatatcaacagaaataaagcgcaagaagtaacgaaacgctatagcattgaagctgatattgcaggcaaccgttttaggggaaaagccaaagcagaaaaagcaggtgatccgatctttactgattcaaattatcttgaagggggattctatggtcctaaagctgaagaaatggcagggaagtttttcacaaataataaatctctctttgcagtatttgcagctaaaagtgaaaacggcgagacgaccacagaacgaatcattgatgcaactaaaattgatttaacccaatttaatgctaaagaactcaacaattttggtgatgcctctgttttaattattgatggacaaaaaatagatctagcaggtgtcaattttaaaaatagtaaaacggttgaaatcaacggcaaaacaatggtagccgtagcttgctgtagtaatctggaatatatgaaatttggtcaattgtggcaaaaagagggcaaacaagttaaagataatagtttattcctacaaggtgaacgtactgcaacggataaaatgcccgcaggaggtaactataagtatgttggaacttgggatgcactcgtatctaaagggacgaactggatagcggaagcagataataatcgagaatcgggctatcgcactgaatttgatgttaattttagtgataaaaaagtaaacggtaagttatttgataaaggcggtgtaaatcctgtatttaccgtagatgcgacaattaatggtaatggctttatcggcagtgcgaaaacctctgatagtggctttgctttagatgcaggctctagccaacacggaaatgcggtatttagtgatataaaagtcaatggtggcttctatggtccaaccgctggagaacttggcggacaattccatcataaatcagacaatggcagtgttggcgctgtctttggtgcaaaacgacaaatagaaaaataa

SEQ ID NO: 1162 - protein, 592 aa, A. pleuropneumoniae TbpB
MHFKLNPYALAFTSLFLVACSGGKGSFDLEDVRPNQTAKAEKATTSYQDEETKKKTKEELDKLMEPALGYETQILRRNKAPKTETGEKRNERVVELSEDKITKLYQESVEIIPHLDELNGKTTSNDVYHSHDSKRLDKNRDLKYVRSGYVYDGSFNEIRRNDSGFHVFKQGIDGYVYYLGVTPSKELPKGKVISYKGTWDFVSNINLDREIDGFDTSGDGKNVSATSITETVNRDHKVGEKLGDNEVKGVAHSSEFAVDFDNKKLTGSLYRNGYINRNKAQEVTKRYSIEADIAGNRFRGKAKAEKAGDPIFTDSNYLEGGFYGPKAEEMAGKFFTNNKSLFAVFAAKSENGETTTERIIDATKIDLTQFNAKELNNFGDASVLIIDGQKIDLAGVNFKNSKTVEINGKTMVAVACCSNLEYMKFGQLWQKEGKQVKDNSLFLQGERTATDKMPAGGNYKYVGTWDALVSKGTNWIAEADNNRESGYRTEFDVNFSDKKVNGKLFDKGGVNPVFTVDATINGNGFIGSAKTSDSGFALDAGSSQHGNAVFSDIKVNGGFYGPTAGELGGQFHHKSDNGSVGAVFGAKRQIEK

SEQ ID NO: 1163 - DNA, 1752 bp, M. haemolytica TbpB
atgtttaaacttaaaagtagttttgtactgcttaatgcggcgctacttgctgcttgttcctcaaatggtggaagctttgatgttcaatctgccaaagttgaatctcaaacgcaaactacccccaaaaagccaagtttacaagatgataatagtaacgcaagacgtacagtaagcgcttctgaaactgaagctttattgcagccggggtttggtttttcagccaaaattccgcgtcgtaatctctttccgcaggggaaggaagatgtagcccctattggtgatataaaagagattactggagatctgacaaaaattccgtatgaagaagaggttaaagcgtacggtagtagtgctgatggatttagccatactcatgatagaaatcataagttgtatactagagattttaattttgttcgttccggctatgttctgcattctggtgcaaaacctgaaataaagcctaaagaaattttgagaacaggtgcacatgggtatgtttactatttaggtatagagccggcaaaagcaatacctactcaaaaagctacttataaaggatattgggattttactaccgatgcgagaaaagggagagatagtaaatatttttctaattccgcaggcatcaatattggcgccacaccggaaaatagttacgatattaatgttgatgattctgaaaaaccaatggggcatacaggagaatttacggctgattttgctaataaaactttaactggaacattggttcgtaatgggtatgttagtcgtagcaaagagcaaaaaattacaacaatttacgatattgatgcaaaaattaaaggtaatcgcttttctggtaaagcaaacgcaaaaaataccgatgatccttattttggtaaaagctctacgacacttgaaggtggattttttggtgggaaggctcaagaacttgccggtaaattcttagctgatgataagtcggtatttgttgtttttgctggcaaacgagatgctaaaaaagatgatagtgaatctgcctttgatgctttcaaaattaaacttaaagatttaaataaatctgagatggatactttcgggaatgcgacacatttgattattaacaataagcagattccacttattgcggaaggcaaaaaaagctttgccgagatgaaatttgatgatttggttacccgtactattgatgataaaacgtatcgagtttcagtctgctgtaataatttagattatgtcaaatttgggacttatagcgagggaaataatagtgatactgctcaccaatatttagtaggagaacgtacagctgtggcagatttgccaacagggacagtaaaatatcgaggtacttgggacggggtaatgtacagtaaatctggctcggcaggggctgaatcgccaagtaacagcgaaagtggtactcgttcactattcgatgtagattttgtcaataaaaaaattaatggcaagctgattgctaatgatggtgttgaagaacgcccaatgctgacacttgaaggcaatctgaaagggaatggttttgcaggcacagccaaaacgggcaattctggttttaatcttgatccgaaaagtacgaatggtggcacggtagtgcatataaatactcaatttgaagggggcttttatggccctaaggcgacggaattaggtggtattgtacatagtgcagaaacggataaagatagagtcagtattacattcggcggaaaacgtcaaatagaaaaataa

SEQ ID NO: 1164 - protein, 583 aa, M. haemolytica TbpB
MFKLKSSFVLLNAALLAACSSNGGSFDVQSAKVESQTQTTPKKPSLQDDNSNARRTVSASETEALLQPGFGFSAKIPRRNLFPQGKEDVAPIGDIKEITGDLTKIPYEEEVKAYGSSADGFSHTHDRNHKLYTRDFNFVRSGYVLHSGAKPEIKPKEILRTGAHGYVYYLGIEPAKAIPTQKATYKGYWDFTTDARKGRDSKYFSNSAGINIGATPENSYDINVDDSEKPMGHTGEFTADFANKTLTGTLVRNGYVSRSKEQKITTIYDIDAKIKGNRFSGKANAKNTDDPYFGKSSTTLEGGFFGGKAQELAGKFLADDKSVFVVFAGKRDAKKDDSESAFDAFKIKLKDLNKSEMDTFGNATHLIINNKQIPLIAEGKKSFAEMKFDDLVTRTIDDKTYRVSVCCNNLDYVKFGTYSEGNNSDTAHQYLVGERTAVADLPTGTVKYRGTWDGVMYSKSGSAGAESPSNSESGTRSLFDVDFVNKKINGKLIANDGVEERPMLTLEGNLKGNGFAGTAKTGNSGFNLDPKSTNGGTVVHINTQFEGGFYGPKATELGGIVHSAETDKDRVSITFGGKRQIEK

SEQ ID NO: 1165 - DNA, 2085 bp, M. catarrhalis TbpB
atgaaacacattcctttaaccacactgtgtgtggcaatctctgccgtcttattaaccgcttgtggtggcagtggtggttcaaatccacctgctcctacgcccattccaaatgctagcggttcaggtaatactggcaacactggtaatgctggcggtactgataatacagccaatgcaggtaatacaggcggtgcaaactctggtacaggcagtgccagcacaccagaaccaaaatatcaagatgtgccaactgagaaaaatgaaaaagataaagtttcacccattcaagaacctgccatgggttatgcaatggaattaaagcttcgtaactatataagcggacaggaagaacatgccaaaatcagtacagatgatgttgtaaaacttgaaggtggcttggagcataagccatttgacaactctatttggcaaaacatcaaaaatagcaaagaagtacaaagtgtttacaaccaagagaagcaaaacattgaaaatcaaatcaaaaaagaaaataaaggacttgatgaagcggcactaaaagctcgtattgaaaaagttcttgatgactatctaacagaacttgctaaacccatttatgaaaaaaatattaattattcacatgatgggcagaataaagcacgcactcgtgatttgacttatgtgcgttctggttatatttatcgctcaggttattctaatatcgactttcaaaagaaaatagctaaaactggttttgatggtgctttattttataaaggtgaacaaactgctaaacaattgcctgtatctgaagttaagtataaaggcacttgggattttatgaccgatgccaaaaataggcaatcatttagcagttttggaggacgagctggtaatcaatatagtgcaatatcttcccatgagtacccatctttattaactgatgagaaaaacaaaccaaataattatactggcgaatatggtcatagcagtgagtttacggtagattttagtaaaaagagcctaaaaggtgagctgtttagtaacctacaagacagccataaaaaaacagtaaccaaaaccaaacgctatgatatcgatgccagtatccacggcaaccgcttccgtggcagtgccaccgcaatcgataaagcaaaagacagcgaaaccaaacacccctttaccagtgatgccaacgataagctagaaggtggtttttatggaccaaacgccgaggagctggcaggtaaattcctaaccgatgacaacaaactctttggtgtctttggtgctaaacgagagagtaaagctggggaaaaaaccgaagccatcttagatgcctatgcacttggtacatttaacaccaaagaagcaaccacattcaccccatttaccaaaaaacaactggataactttggcaatgccaaaaagttggtcttgggttctaccgtcattgatttggtgcctaccgatgccaccaaatatgtcaataaatttcaccaaaaaaagccagagtctgccacaaacaaagcgggcgagactttgatggtgaatgatgaagttagcgtcaaaacctatggcaaaaactttgaatacctaaaatttggtgagctcagtgtcggcacaagcaacagcgtctttttacaaggcgaacgcaccgctaccacaggcgataaagccgtaccaaccacaggcgcagccaaatatttggggaactgggtaggatacatcacaggaaaggacacaggagcgggctcatcaaaaggctttaccgatgccaaagatgttgctgattttgacattgactttgagaaaaaaacagttaatggcaaactgaccacccaaggccgccaagaccctgtatttagcatcacaggtaacatctcaggtaatggctggacaggcaaagccagcaccgccgaagcggacgcagggggctacaagatagattctagcagtacaggcaaatccatcgtcatcaaagatgccgaggttactgggggcttttatggtccaaatgcaaacgagatgggtgggtcatttacacacaacgctgatgacaaagtctctgtggtctttggcgcaaaaaaacaagaagttaagtag

SEQ ID NO: 1166 - protein, 694 aa, M. catarrhalis TbpB
MKHIPLTTLCVAISAVLLTACGGSGGSNPPAPTPIPNASGSGNTGNTGNAGGTDNTANAGNTGGANSGTGSASTPEPKYQDVPTEKNEKDKVSPIQEPAMGYAMELKLRNYISGQEEHAKISTDDVVKLEGGLEHKPFDNSIWQNIKNSKEVQSVYNQEKQNIENQIKKENKGLDEAALKARIEKVLDDYLTELAKPIYEKNINYSHDGQNKARTRDLTYVRSGYIYRSGYSNIDFQKKIAKTGFDGALFYKGEQTAKQLPVSEVKYKGTWDFMTDAKNRQSFSSFGGRAGNQYSAISSHEYPSLLTDEKNKPNNYTGEYGHSSEFTVDFSKKSLKGELFSNLQDSHKKTVTKTKRYDIDASIHGNRFRGSATAIDKAKDSETKHPFTSDANDKLEGGFYGPNAEELAGKFLTDDNKLFGVFGAKRESKAGEKTEAILDAYALGTFNTKEATTFTPFTKKQLDNFGNAKKLVLGSTVIDLVPTDATKYVNKFHQKKPESATNKAGETLMVNDEVSVKTYGKNFEYLKFGELSVGTSNSVFLQGERTATTGDKAVPTTGAAKYLGNWVGYITGKDTGAGSSKGFTDAKDVADFDIDFEKKTVNGKLTTQGRQDPVFSITGNISGNGWTGKASTAEADAGGYKIDSSSTGKSIVIKDAEVTGGFYGPNANEMGGSFTHNADDKVSVVFGAKKQEVK

SEQ ID NO: 1167 - DNA, 1893 bp, H. influenzae TbpB
atgaaatctgtacctcttatcactggtggactttcctttttattaagcgcttgtagcgggggaggtggttcttttgatgtagatgacgtctctaatccctcctcttctaaaccacgttatcaagacgatacttcaagttcaagaacaaaatctaatttggaaaagttgtccattccttctttaggaggagggatgaagttagtggctcagaatctgagtggtaataaagaacctagtttcttaaatgaaaatggctatatatcatatttttcctcaccttctacgattgaagatgatgttaaaaatgttaaaacagaaaataaaatacatacaaatccaattgggcttgaacctaatagagcattacaagaccccaatttacaaaaatacgtttattctggtttgtactatattgagaattggaaagacttttccaaattagcaacagaaaaaaaagcctatagtggccattatggttatgcgttttattatggtaataaaactgcaacagacttgccagtaagcggtgtagcaacgtataaaggaacttgggatttcatcactgcaactaaatatggccaaaattattctttgttcagtaatgctagaggtcaagcttattttcgacgtagtgctactcgaggagatattgatttagaaaataattcaaagaatggtgatataggcttaataagtgaatttagtgcagattttgggactaaaaaactgacaggacaactgtcttacaccaaaagaaaaactgatattcaacaatatgaaaaggaaaaactctatgatatagatgcccatatttatagtaatagattcaggggtaaagttactcctacgaaatccacatcggatgaacatccctttaccagcgagggaacattagaaggtggtttttatggacctaatgctgaagaactagggggtaaattcttagctagggataaacgagtttttggggtatttagtgccaaagaaacgccagaaacagaaaaggaaaaattatccaaagaaaccttaattgatggcaagctaattactttctctactaaaacagccgatgcaacaaccagtacaacagccagtacaacagccgatgtaaaaaccgatgaaaaaaactttacgacaaaagatatatcaagttttggtgaagctgattaccttttaattgataattaccctgttcctcttttccctgaaggggatactgatgacttcgtaacgagtaaacatcacgatattggaaataaaacctataaagtagaagcatgttgcaagaatctaagctatgtaaaatttggtatgtattatgaggataaagagaagaaaaacacaaatcaaacaggacaataccaccaatttttgttaggtctccgtactcccagttctcaaattcctgtaacgggaaacgtgaaatatctcggtagttggtttggttatattggtgatgacaagacatcttactccactacaggaaataaacaacaagataaaaatgctcccgccgagtttgatgtcaattttgacaataaaacattaacaggcaaattaaaacgagccgactcacaaaataccgtgtttaacattgaggcaacctttaaaaatggtagtaatgccttcgaaggtaaagcaaccgcaaatgtagtgattgatcccaaaaatacacaagccacatctaaagtcaatttcacgacaacagtaaacggggcattttatggtccgcacgctacagaattaggcggttatttcacctataacggaaacaatcctacagctacaaattctgaaagttcctcaaccgtaccttcaccacccaattcaccaaatgcaagagctgcagttgtctttggagctaaaagacaagtagaaaaaaccaacaagtag

SEQ ID NO: 1168 - protein, 630 aa, H. influenzae TbpB
MKSVPLITGGLSFLLSACSGGGGSFDVDDVSNPSSSKPRYQDDTSSSRTKSNLEKLSIPSLGGGMKLVAQNLSGNKEPSFLNENGYISYFSSPSTIEDDVKNVKTENKIHTNPIGLEPNRALQDPNLQKYVYSGLYYIENWKDFSKLATEKKAYSGHYGYAFYYGNKTATDLPVSGVATYKGTWDFITATKYGQNYSLFSNARGQAYFRRSATRGDIDLENNSKNGDIGLISEFSADFGTKKLTGQLSYTKRKTDIQQYEKEKLYDIDAHIYSNRFRGKVTPTKSTSDEHPFTSEGTLEGGFYGPNAEELGGKFLARDKRVFGVFSAKETPETEKEKLSKETLIDGKLITFSTKTADATTSTTASTTADVKTDEKNFTTKDISSFGEADYLLIDNYPVPLFPEGDTDDFVTSKHHDIGNKTYKVEACCKNLSYVKFGMYYEDKEKKNTNQTGQYHQFLLGLRTPSSQIPVTGNVKYLGSWFGYIGDDKTSYSTTGNKQQDKNAPAEFDVNFDNKTLTGKLKRADSQNTVFNIEATFKNGSNAFEGKATANVVIDPKNTQATSKVNFTTTVNGAFYGPHATELGGYFTYNGNNPTATNSESSSTVPSPPNSPNARAAVVFGAKRQVEKTNK

SEQ ID NO: 1169 - DNA, 180 bp, N. meningitidis TbpB lipobox plus anchor peptide
atgaacaatccattggtaaatcaggctgctatggtgctgcctgtgtttttgttgagtgcttgtctgggtggcggcggcagtttcgatttggacagcgtggaaaccgtgcaagatatgcactccaaacctaagtatgaggatgaaaaaagccagcctgaaagccaacaggatgtatcggaa

SEQ ID NO: 1170 - protein, 60 aa, N. meningitidis TbpB lipobox plus anchor peptide
MNNPLVNQAAMVLPVFLLSACLGGGGSFDLDSVETVQDMHSKPKYEDEKSQPESQQDVSE

SEQ ID NO: 1171 - DNA, 63 bp, N. meningitidis TbpB signal sequence
atgaacaatccattggtaaatcaggctgctatggtgctgcctgtgtttttgttgagtgcttgt

SEQ ID NO: 1172 - protein, 21 aa, N. meningitidis TbpB signal sequence
MNNPLVNQAAMVLPVFLLSAC

SEQ ID NO: 1173 - DNA, 12 bp, N. meningitidis TbpB lipobox
ttgagtgcttgt

SEQ ID NO: 1174 - protein, 4 aa, N. meningitidis TbpB lipobox
LSAC

SEQ ID NO: 1175 - DNA, 117 bp, N. meningitidis TbpB anchor peptide
ctgggtggcggcggcagtttcgatttggacagcgtggaaaccgtgcaagatatgcactccaaacctaagtatgaggatgaaaaaagccagcctgaaagccaacaggatgtatcggaa

SEQ ID NO: 1176 - protein, 39 aa, N. meningitidis TbpB anchor peptide
LGGGGSFDLDSVETVQDMHSKPKYEDEKSQPESQQDVSE

SEQ ID NO: 1177 - DNA, 765 bp, A.  baumannii
atgggcagcagccatcatcatcatcatcacagcggaattgatggtatttcgagtaatgaaagtaacatcaaaatcggtgctgctgccaatgcaagtcatccgggtggtgtagcagcggtgtcggttcaagctgcgggtgcgccatataacgcttttacaggttttagttcgttaaaaggtttggctcaggcttttgctgctcagggaacgagtaacaccaatgtaacggttggcagcaaaacctttaatatttcacatattccagtgtctgcaatgccaccttcacacagtgcattaggtaattttaactttggtcaggtgggcacacaggaagtctattttggtgaatggtggaaagcgggcgacacgccggcaagcgcgagccataccgtttactacgcgggtgataataccaataccactgttccaaccgcgggtactgcaacttataccgttgcagggattaacggctctggaagcaatctgttaagtggtacgttcacggcaaattatggcgcgggtacacttgaaggaacacttactggaactggtacggctgtttcatcattaagcctagatggtgtggcatttaacccgggtactgctgcgtttgcaggtttggcaacggctaacggtacggctggtatcgacaactctggtgtggtgcaaggtcaattctttggtgcaaatgcttcggctttagcgggtattgcccagtttgataacgtgtcttacaacactgcatttggcggtgctaaaaattaa

SEQ ID NO: 1178 - protein, 254 aa, A. baumannii
MGSSHHHHHHSGIDGISSNESNIKIGAAANASHPGGVAAVSVQAAGAPYNAFTGFSSLKGLAQAFAAQGTSNTNVTVGSKTFNISHIPVSAMPPSHSALGNFNFGQVGTQEVYFGEWWKAGDTPASASHTVYYAGDNTNTTVPTAGTATYTVAGINGSGSNLLSGTFTANYGAGTLEGTLTGTGTAVSSLSLDGVAFNPGTAAFAGLATANGTAGIDNSGVVQGQFFGANASALAGIAQFDNVSYNTAFGGAKN

SEQ ID NO: 1179 - DNA, 70 bp, E. coli
atgaaatacctgctgccgaccgctgctgctggtctgctgctcctcgctgcccagccggcgatggccatgg

SEQ ID NO: 1180 - protein, 23 aa, E. coli
MKYLLPTAAAGLLLLAAQPAMAM

SEQ ID NO: 1181 - DNA, 1446 bp, N. meningitidis
atgaaatacctgctgccgaccgctgctgctggtctgctgctcctcgctgcccagccggcgatggccatgggcgaagaaacaccgcgcgaaccggatttgagaagccgtcccgagttcaggcttcatgaagcggaggtcaaaccaatcgacagggagaaggtaccggggcaggtgcgggaaaaaggaaaagttttgcagattgacggagaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcggcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggctggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 1182 - protein, 481 aa, N. meningitidis
MKYLLPTAAAGLLLLAAQPAMAMGEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIAAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 1183 - DNA, 1467 bp, N. meningitidis B16B6
atggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccaatcgacagggagaaggtaccggggcaggtgcgggaaaaaggaaaagttttgcagattgacggagaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcggcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggctggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 1184 - protein, 488 aa, N. meningitidis B16B6; identical to SEQ ID NO: 386

The invention claimed is:

1. A method of causing transport of a TbpB target protein comprising SEQ.ID NO: 1150 or a sequence at least 90% identical thereto from the cytosol to the extracellular surface of a host cell comprising the TbpB target protein, the method comprising:

(a) providing a chimeric polynucleotide comprising as operably linked components:

(i) a polynucleotide capable of controlling expression in the host cell; and (ii) a polynucleotide encoding a Surface Lipoprotein Assembly Modulator (SLAM) polypeptide comprising SEQ.ID NO: 1184 or a sequence at least 90% identical thereto; and (b) introducing the chimeric polynucleotide in the host cell and growing the host cell to express and produce the SLAM polypeptide, thereby causing transport of the target protein from the cytosol to the extracellular surface of the host cell.

2. The method according to claim 1 further comprising in step (b):

providing a second chimeric polynucleotide comprising as operably linked components:

(i) a polynucleotide capable of controlling expression in the host cell; and (ii) a polynucleotide encoding the target protein; and in step (c) introducing the first and second chimeric polynucleotide in the host cell and growing the host cell to express and produce the SLAM polypeptide and the target protein and cause transport of the target protein from the cytosol to the extracellular surface.

3. A method according to claim 1 wherein the TbpB target protein comprises SEQ.ID NO: 1150 or a sequence at least 95% identical thereto.

4. A method according to claim 2 wherein the TbpB target protein comprises SEQ.ID NO: 1150 or a sequence at least 95% identical thereto.

5. A method according to claim 1 wherein the SLAM polypeptide comprises SEQ.ID NO: 1184 or a sequence at least 95% identical thereto.

6. A method according to claim 2 wherein the SLAM polypeptide comprises SEQ.ID NO: 1184 or a sequence at least 95% identical thereto.

7. A method according to claim 1 wherein the TbpB target protein comprises SEQ.ID NO: 1150.

8. A method according to claim 2 wherein the TbpB target protein comprises SEQ.ID NO: 1150.

9. A method according to claim 1 wherein the SLAM polypeptide comprises SEQ.ID NO: 1184.

10. A method according to claim 2 wherein the SLAM polypeptide comprises SEQ.ID NO: 1184.

* * * * *